US011576961B2

(12) United States Patent
Ciaramella et al.

(10) Patent No.: US 11,576,961 B2
(45) Date of Patent: *Feb. 14, 2023

(54) BROAD SPECTRUM INFLUENZA VIRUS VACCINE

(71) Applicant: ModernaTX, Inc., Cambridge, MA (US)

(72) Inventors: Giuseppe Ciaramella, Sudbury, MA (US); Eric Yi-Chun Huang, Boston, MA (US); Kerim Babaoglu, Lansdale, PA (US); Jessica Anne Flynn, Lansdale, PA (US); Lan Zhang, Chalfont, PA (US); David Nickle, Seattle, WA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/493,986

(22) PCT Filed: Mar. 15, 2018

(86) PCT No.: PCT/US2018/022605
§ 371 (c)(1),
(2) Date: Sep. 13, 2019

(87) PCT Pub. No.: WO2018/170245
PCT Pub. Date: Sep. 20, 2018

(65) Prior Publication Data
US 2021/0187097 A1   Jun. 24, 2021
US 2022/0080038 A9   Mar. 17, 2022

Related U.S. Application Data

(60) Provisional application No. 62/490,057, filed on Apr. 26, 2017, provisional application No. 62/471,771, filed on Mar. 15, 2017.

(51) Int. Cl.
*A61K 39/145* (2006.01)
*A61K 39/00* (2006.01)

(52) U.S. Cl.
CPC .... *A61K 39/145* (2013.01); *A61K 2039/5252* (2013.01); *A61K 2039/5254* (2013.01);
(Continued)

(58) Field of Classification Search
None
See application file for complete search history.

(56) References Cited

U.S. PATENT DOCUMENTS 6,040,427 A    3/2000  Locht et al.
6,500,419 B1  12/2002  Hone et al.
(Continued)

FOREIGN PATENT DOCUMENTS

AU            652831 B2   9/1994
AU         2015210364 A1  3/2017
(Continued)

OTHER PUBLICATIONS

International Search Report and Written Opinion for Application No. PCT/US2018/022605 dated Aug. 7, 2018.
(Continued)

*Primary Examiner* — Shanon A. Foley
(74) *Attorney, Agent, or Firm* — Wolf, Greenfield & Sacks, P.C.

(57) ABSTRACT

The disclosure relates to broad spectrum influenza virus ribonucleic acid (RNA) vaccines, as well as methods of using the vaccines and compositions comprising the vaccine. In a preferred embodiment, the vaccine is formulated as a lipid nanoparticle comprising at least one cationic lipid.

24 Claims, 24 Drawing Sheets

Specification includes a Sequence Listing.

(52) U.S. Cl.
CPC ...... *A61K 2039/53* (2013.01); *A61K 2039/54* (2013.01); *A61K 2039/55516* (2013.01); *A61K 2039/55555* (2013.01); *A61K 2039/572* (2013.01); *A61K 2039/575* (2013.01); *A61K 2039/6093* (2013.01)

(56) References Cited

U.S. PATENT DOCUMENTS

| | | |
|---|---|---|
| 6,514,948 B1 | 2/2003 | Raz et al. |
| 6,610,044 B2 | 8/2003 | Mathiesen |
| 7,001,890 B1 | 2/2006 | Wagner et al. |
| 7,566,454 B2 | 7/2009 | Lu et al. |
| 8,569,256 B2 | 10/2013 | Heyes et al. |
| 8,609,142 B2 | 12/2013 | Troiano et al. |
| 8,613,954 B2 | 12/2013 | Zale et al. |
| 8,617,608 B2 | 12/2013 | Zale et al. |
| 8,691,966 B2 | 4/2014 | Kariko et al. |
| 8,692,292 B2 | 4/2014 | Umeda et al. |
| 8,710,200 B2 | 4/2014 | Schrum et al. |
| 8,734,832 B2 | 5/2014 | O'Hagan et al. |
| 8,734,853 B2 | 5/2014 | Sood et al. |
| 8,754,062 B2 | 6/2014 | De Fougerolles et al. |
| 8,822,663 B2 | 9/2014 | Schrum et al. |
| 8,999,380 B2 | 4/2015 | Bancel et al. |
| 9,221,891 B2 | 12/2015 | Bancel et al. |
| 9,283,287 B2 | 3/2016 | Bancel et al. |
| 9,303,079 B2 | 4/2016 | Bancel et al. |
| 9,464,124 B2 | 10/2016 | Bancel et al. |
| 9,512,456 B2 | 12/2016 | Wang et al. |
| 9,533,047 B2 | 1/2017 | de Fougerolles et al. |
| 9,597,380 B2 | 3/2017 | Chakraborty et al. |
| 9,803,199 B2 | 10/2017 | Koizumi et al. |
| 9,868,691 B2 | 1/2018 | Benenato et al. |
| 9,872,900 B2 | 1/2018 | Ciaramella et al. |
| 10,064,934 B2 | 9/2018 | Ciaramella et al. |
| 10,064,935 B2 | 9/2018 | Ciaramella et al. |
| 10,124,055 B2 | 11/2018 | Ciaramella et al. |
| 10,207,010 B2 | 2/2019 | Besin et al. |
| 10,232,055 B2 | 3/2019 | Kariko et al. |
| 10,273,269 B2 | 4/2019 | Ciaramella |
| 10,286,086 B2 | 5/2019 | Roy et al. |
| 10,323,076 B2 | 6/2019 | Ellsworth et al. |
| 10,385,088 B2 | 8/2019 | Fraley et al. |
| 10,449,244 B2 | 10/2019 | Ciaramella et al. |
| 10,465,190 B1 | 11/2019 | Chen et al. |
| 10,493,143 B2 | 12/2019 | Ciaramella et al. |
| 10,526,629 B2 | 1/2020 | Rabideau et al. |
| 10,653,712 B2 | 5/2020 | Hoge |
| 10,653,767 B2 | 5/2020 | Ciaramella et al. |
| 10,695,419 B2 | 6/2020 | Ciaramella et al. |
| 10,857,105 B2 | 12/2020 | Benenato et al. |
| 10,925,958 B2* | 2/2021 | Ciaramella ............ A61P 31/16 |
| 11,045,540 B2 | 6/2021 | Ciaramella |
| 11,103,578 B2 | 8/2021 | Ciaramella et al. |
| 11,351,242 B1 | 6/2022 | Lori et al. |
| 11,384,352 B2 | 7/2022 | Miracco |
| 11,406,703 B2 | 8/2022 | Kramarczyk et al. |
| 2001/0001066 A1 | 5/2001 | Cezayirli et al. |
| 2003/0032615 A1 | 2/2003 | Feigner et al. |
| 2004/0132683 A1 | 7/2004 | Feigner et al. |
| 2005/0032730 A1 | 2/2005 | Von Der Mulbe et al. |
| 2005/0059624 A1 | 3/2005 | Hoerr et al. |
| 2005/0287540 A1 | 12/2005 | Murphy et al. |
| 2006/0172003 A1 | 8/2006 | Meers et al. |
| 2006/0172966 A1 | 8/2006 | Lipford et al. |
| 2006/0217338 A1 | 9/2006 | Lu et al. |
| 2010/0068226 A1 | 3/2010 | Taylor et al. |
| 2010/0130588 A1 | 5/2010 | Yaworski et al. |
| 2010/0189729 A1 | 7/2010 | Hoerr et al. |
| 2011/0065095 A1 | 3/2011 | Kida et al. |
| 2012/0058153 A1 | 3/2012 | Ilyinskii et al. |
| 2012/0101148 A1 | 4/2012 | Aking et al. |
| 2012/0189700 A1 | 7/2012 | Aguilar et al. |
| 2012/0295832 A1 | 11/2012 | Constien et al. |
| 2013/0102034 A1 | 4/2013 | Schrum et al. |
| 2013/0121988 A1 | 5/2013 | Hoerr et al. |
| 2013/0142818 A1 | 6/2013 | Baumhof et al. |
| 2013/0171241 A1 | 7/2013 | Geall |
| 2013/0183355 A1 | 7/2013 | Jain et al. |
| 2013/0189351 A1 | 7/2013 | Geall |
| 2013/0195867 A1 | 8/2013 | Hoerr et al. |
| 2013/0195968 A1 | 8/2013 | Geall et al. |
| 2013/0195969 A1 | 8/2013 | Geall et al. |
| 2013/0236974 A1 | 9/2013 | de Fougerolles et al. |
| 2013/0245103 A1 | 9/2013 | De Fougerolles et al. |
| 2013/0259923 A1 | 10/2013 | Bancel et al. |
| 2013/0266640 A1 | 10/2013 | De Fougerolles et al. |
| 2014/0065228 A1 | 3/2014 | Yarowoski et al. |
| 2014/0134201 A1 | 5/2014 | Tureci et al. |
| 2014/0147432 A1 | 5/2014 | Bancel et al. |
| 2014/0148502 A1 | 5/2014 | Bancel et al. |
| 2014/0193482 A1 | 7/2014 | Bancel et al. |
| 2014/0193484 A1 | 7/2014 | Girardin et al. |
| 2014/0206752 A1 | 7/2014 | Afeyan et al. |
| 2014/0255472 A1 | 9/2014 | Geall et al. |
| 2014/0302079 A1 | 10/2014 | Nable et al. |
| 2014/0308304 A1 | 10/2014 | Manoharan et al. |
| 2014/0378538 A1 | 12/2014 | Bancel |
| 2015/0051268 A1 | 2/2015 | Bancel et al. |
| 2015/0056253 A1 | 2/2015 | Bancel et al. |
| 2015/0141499 A1 | 5/2015 | Bancel et al. |
| 2015/0307542 A1 | 10/2015 | Roy et al. |
| 2015/0315541 A1 | 11/2015 | Bancel et al. |
| 2016/0024140 A1 | 1/2016 | Issa et al. |
| 2016/0024141 A1 | 1/2016 | Issa et al. |
| 2016/0032273 A1 | 2/2016 | Shahrokh et al. |
| 2016/0038612 A1 | 2/2016 | Hoge et al. |
| 2016/0243221 A1 | 8/2016 | Hoge et al. |
| 2016/0317647 A1 | 11/2016 | Ciaramella et al. |
| 2017/0043037 A1 | 2/2017 | Kariko et al. |
| 2017/0202979 A1 | 7/2017 | Chakraborty et al. |
| 2017/0204152 A1 | 7/2017 | Nelson et al. |
| 2017/0210698 A1 | 7/2017 | Benenato et al. |
| 2017/0130255 A1 | 10/2017 | Wang et al. |
| 2018/0000953 A1 | 1/2018 | Almarsson et al. |
| 2018/0002393 A1 | 1/2018 | Bancel et al. |
| 2018/0021258 A1 | 1/2018 | Graham et al. |
| 2018/0028664 A1 | 2/2018 | Besin et al. |
| 2018/0237849 A1 | 8/2018 | Thompson |
| 2018/0243225 A1 | 8/2018 | Ciaramella |
| 2018/0243230 A1 | 8/2018 | Smith |
| 2018/0256628 A1 | 9/2018 | Hoge et al. |
| 2018/0271795 A1 | 9/2018 | Martini et al. |
| 2018/0271970 A1 | 9/2018 | Ciaramella et al. |
| 2018/0273977 A1 | 9/2018 | Mousavi et al. |
| 2018/0274009 A1 | 9/2018 | Marquardt et al. |
| 2018/0280496 A1 | 10/2018 | Ciaramella et al. |
| 2018/0289792 A1 | 10/2018 | Ciaramella et al. |
| 2018/0296663 A1 | 10/2018 | Hipp et al. |
| 2018/0303929 A1 | 10/2018 | Ciaramella et al. |
| 2018/0311336 A1 | 11/2018 | Ciaramella et al. |
| 2018/0311343 A1 | 11/2018 | Huang et al. |
| 2018/0318409 A1 | 11/2018 | Valiante et al. |
| 2018/0326039 A1 | 11/2018 | Haruta |
| 2018/0363019 A1 | 12/2018 | Hoge |
| 2018/0369374 A1 | 12/2018 | Frederick et al. |
| 2018/0371047 A1 | 12/2018 | Ticho et al. |
| 2019/0002890 A1 | 1/2019 | Martini et al. |
| 2019/0008938 A1 | 1/2019 | Ciaramella et al. |
| 2019/0085368 A1 | 3/2019 | Bancel et al. |
| 2019/0099481 A1 | 4/2019 | Ciaramella et al. |
| 2019/0175517 A1 | 6/2019 | Martini et al. |
| 2019/0175727 A1 | 6/2019 | Huang et al. |
| 2019/0192646 A1 | 6/2019 | Cohen et al. |
| 2019/0192653 A1 | 6/2019 | Hoge et al. |
| 2019/0275170 A1 | 9/2019 | Benenato et al. |
| 2019/0298657 A1 | 10/2019 | Martini et al. |
| 2019/0298658 A1 | 10/2019 | Benenato |
| 2019/0300906 A1 | 10/2019 | Martini et al. |
| 2019/0309337 A1 | 10/2019 | Rabideau et al. |
| 2019/0314292 A1 | 10/2019 | Benenato et al. |
| 2019/0314493 A1 | 10/2019 | Ciaramella et al. |
| 2019/0336452 A1 | 11/2019 | Brader |
| 2019/0336595 A1 | 11/2019 | Ciaramella |

(56) References Cited

U.S. PATENT DOCUMENTS

| | | |
|---|---|---|
| 2019/0351040 A1 | 11/2019 | Valiante et al. |
| 2019/0382774 A1 | 12/2019 | Hoge et al. |
| 2019/0390181 A1 | 12/2019 | Benenato et al. |
| 2020/0030432 A1 | 1/2020 | Ciaramella et al. |
| 2020/0032274 A1 | 1/2020 | Mauger et al. |
| 2020/0038499 A1 | 2/2020 | Narayanan et al. |
| 2020/0054737 A1 | 2/2020 | Ciaramella et al. |
| 2020/0069599 A1 | 3/2020 | Smith et al. |
| 2020/0069793 A1 | 3/2020 | Ciaramella |
| 2020/0069794 A1 | 3/2020 | Ciaramella et al. |
| 2020/0071689 A1 | 3/2020 | Miracco |
| 2020/0085916 A1 | 3/2020 | Martini et al. |
| 2020/0109420 A1 | 4/2020 | Brito et al. |
| 2020/0129608 A1 | 4/2020 | Ciaramella et al. |
| 2020/0129615 A1 | 4/2020 | Ciaramella et al. |
| 2020/0163878 A1 | 5/2020 | Baumhof et al. |
| 2020/0239869 A1 | 7/2020 | Issa et al. |
| 2020/0254086 A1 | 8/2020 | Hoge et al. |
| 2020/0282047 A1 | 9/2020 | Ciaramella et al. |
| 2020/0306191 A1 | 10/2020 | Schariter et al. |
| 2020/0368162 A1 | 11/2020 | Martini |
| 2021/0023199 A1 | 1/2021 | Kallen et al. |
| 2021/0030866 A1 | 2/2021 | Kallen et al. |
| 2021/0046173 A1 | 2/2021 | Ciaramella et al. |
| 2021/0163919 A1 | 6/2021 | Issa et al. |
| 2021/0187097 A1* | 6/2021 | Ciaramella .......... A61K 39/145 |
| 2021/0206818 A1 | 7/2021 | Huang et al. |
| 2021/0217484 A1 | 7/2021 | Giessel et al. |
| 2021/0228707 A1 | 7/2021 | Mektar et al. |
| 2021/0268086 A1 | 9/2021 | Zhong et al. |
| 2021/0309976 A1 | 10/2021 | Dousis et al. |
| 2022/0031631 A1 | 2/2022 | Almarsson et al. |
| 2022/0047518 A1 | 2/2022 | Hennessy et al. |
| 2022/0054653 A1 | 2/2022 | Martini et al. |
| 2022/0062175 A1 | 3/2022 | Smith et al. |
| 2022/0125899 A1 | 4/2022 | Ashburn et al. |
| 2022/0145381 A1 | 5/2022 | Elich et al. |
| 2022/0236253 A1 | 7/2022 | Hopson |
| 2022/0241399 A1 | 8/2022 | Lusso et al. |

FOREIGN PATENT DOCUMENTS

| | | |
|---|---|---|
| CA | 2473135 A1 | 6/2003 |
| CN | 110974954 A | 4/2020 |
| CN | 112546211 A | 3/2021 |
| EP | 1083232 B1 | 2/2005 |
| EP | 1301614 B1 | 11/2006 |
| EP | 1383556 B1 | 10/2007 |
| EP | 1905844 A2 | 4/2008 |
| EP | 1026253 B2 | 12/2012 |
| EP | 2188379 B1 | 1/2013 |
| WO | WO 1990/011092 A1 | 10/1990 |
| WO | WO 1992/019752 A1 | 11/1992 |
| WO | WO 1999/052503 A2 | 10/1999 |
| WO | WO 2001/021810 A1 | 3/2001 |
| WO | WO 2004/058166 A2 | 7/2004 |
| WO | WO 2005/007689 A1 | 1/2005 |
| WO | WO 2005/120152 | 12/2005 |
| WO | WO 2007/094854 A2 | 8/2007 |
| WO | WO 2008/014979 A3 | 2/2008 |
| WO | WO 2008/052770 A2 | 5/2008 |
| WO | WO 2008/083949 A2 | 7/2008 |
| WO | WO 2008/103276 A2 | 8/2008 |
| WO | WO 2010/037408 A1 | 4/2010 |
| WO | WO 2010/042877 A1 | 4/2010 |
| WO | WO 2010/054406 A1 | 5/2010 |
| WO | WO 2010/088927 A1 | 8/2010 |
| WO | WO 2010/115046 A2 | 10/2010 |
| WO | WO 2011/005799 A2 | 1/2011 |
| WO | WO 2011/069529 A1 | 6/2011 |
| WO | WO 2011/069586 A1 | 6/2011 |
| WO | WO 2012/024629 A1 | 8/2011 |
| WO | WO 2011/140627 A1 | 11/2011 |
| WO | WO 2011/144358 A1 | 11/2011 |
| WO | WO 2012/006369 A2 | 1/2012 |
| WO | WO 2012/006376 A2 | 1/2012 |
| WO | WO 2012/006380 A2 | 1/2012 |
| WO | WO 2012/019630 A1 | 2/2012 |
| WO | WO 2012/019780 A1 | 2/2012 |
| WO | WO 2012/075040 A2 | 6/2012 |
| WO | WO 2012/089225 A1 | 7/2012 |
| WO | WO 2012/113513 A1 | 8/2012 |
| WO | WO 2012/116714 A1 | 9/2012 |
| WO | WO 2012/116715 A1 | 9/2012 |
| WO | WO 2012/116810 A1 | 9/2012 |
| WO | WO 2012/116811 A1 | 9/2012 |
| WO | WO 2012/170930 A1 | 12/2012 |
| WO | WO 2012/177760 A1 | 12/2012 |
| WO | WO 2013/006825 A1 | 1/2013 |
| WO | WO 2013/006837 A1 | 1/2013 |
| WO | WO 2013/006838 A1 | 1/2013 |
| WO | WO 2013/006842 A2 | 1/2013 |
| WO | WO 2013/024865 A1 | 2/2013 |
| WO | WO 2013/030778 A2 | 3/2013 |
| WO | WO 2013/052167 A2 | 4/2013 |
| WO | WO 2013/056132 A2 | 4/2013 |
| WO | WO 2013/059496 A1 | 4/2013 |
| WO | WO 2013/113502 A1 | 8/2013 |
| WO | WO 2013/143555 A1 | 10/2013 |
| WO | WO 2013/174409 A1 | 11/2013 |
| WO | WO 2013/185069 A1 | 12/2013 |
| WO | WO 2014/071963 A1 | 5/2014 |
| WO | WO 2014/072061 A1 | 5/2014 |
| WO | WO 2014/089486 A1 | 6/2014 |
| WO | WO 2014/127917 A1 | 8/2014 |
| WO | WO 2014/136086 A1 | 9/2014 |
| WO | WO 2014/144196 A1 | 9/2014 |
| WO | WO 2014/152027 A1 | 9/2014 |
| WO | WO 2014/152774 A1 | 9/2014 |
| WO | WO 2014/160243 A1 | 10/2014 |
| WO | WO 2015/005253 A1 | 1/2015 |
| WO | WO 2015/013551 A1 | 1/2015 |
| WO | WO 2015/024667 A1 | 2/2015 |
| WO | WO 2015/024668 A2 | 2/2015 |
| WO | WO 2015/024669 A1 | 2/2015 |
| WO | WO 2015/164674 A1 | 4/2015 |
| WO | WO 2015/095346 A1 | 6/2015 |
| WO | WO 2015/149944 A2 | 10/2015 |
| WO | WO 2015/164674 * | 10/2015 |
| WO | WO 2015/189425 A1 | 12/2015 |
| WO | WO 2015/199952 A1 | 12/2015 |
| WO | WO 2016/164762 A1 | 10/2016 |
| WO | WO 2020/061367 A1 | 10/2016 |
| WO | WO 2016/176330 A1 | 11/2016 |
| WO | WO 2016/201377 A1 | 12/2016 |
| WO | WO 2016/203025 A1 | 12/2016 |
| WO | WO 2017/011773 A2 | 1/2017 |
| WO | WO 2017/015457 A1 | 1/2017 |
| WO | WO 2017/020026 A1 | 2/2017 |
| WO | WO 2017/049245 A2 | 3/2017 |
| WO | WO 2017/153936 | 3/2017 |
| WO | WO 2017/062513 A1 | 4/2017 |
| WO | WO 2017/066789 A1 | 4/2017 |
| WO | WO 2017/070601 A1 | 4/2017 |
| WO | WO 2017/070618 A1 | 4/2017 |
| WO | WO 2017/070620 A1 | 4/2017 |
| WO | WO 2017/070623 A1 | 4/2017 |
| WO | WO 2017/075038 A1 | 5/2017 |
| WO | WO 2017/075531 A1 | 5/2017 |
| WO | WO 2017/081082 A1 | 5/2017 |
| WO | WO 2017/127750 A1 | 7/2017 |
| WO | WO 2017/191258 A1 | 11/2017 |
| WO | WO 2017/201333 A1 | 11/2017 |
| WO | WO 2017/201340 A1 | 11/2017 |
| WO | WO 2017/201342 A1 | 11/2017 |
| WO | WO 2017/201347 A1 | 11/2017 |
| WO | WO 2017/201349 A1 | 11/2017 |
| WO | WO 2018/053209 A1 | 3/2018 |
| WO | WO 2018/075592 A1 | 4/2018 |
| WO | WO 2018/075980 A1 | 4/2018 |
| WO | WO 2018/078053 A1 | 5/2018 |
| WO | WO 2018/081459 A1 | 5/2018 |
| WO | WO 2018/081638 A1 | 5/2018 |
| WO | WO 2018/089801 A1 | 5/2018 |

(56) References Cited

FOREIGN PATENT DOCUMENTS

| | | |
|---|---|---|
| WO | WO 2018/089851 A1 | 5/2018 |
| WO | WO 2018/107088 A1 | 6/2018 |
| WO | WO 2018/111967 A1 | 6/2018 |
| WO | WO 2018/144082 A1 | 8/2018 |
| WO | WO 2018/144778 A1 | 8/2018 |
| WO | WO 2018/151816 A1 | 8/2018 |
| WO | WO 2018/157009 A1 | 8/2018 |
| WO | WO 2018/170245 A1 | 9/2018 |
| WO | WO 2018/170256 A1 | 9/2018 |
| WO | WO 2018/170260 A1 | 9/2018 |
| WO | WO 2018/170270 A1 | 9/2018 |
| WO | WO 2018/170347 A1 | 9/2018 |
| WO | WO 2018/175783 A1 | 9/2018 |
| WO | WO 2018/187590 A2 | 10/2018 |
| WO | WO 2018/200737 A1 | 11/2018 |
| WO | WO 2018/232355 A1 | 12/2018 |
| WO | WO 2018/232357 A1 | 12/2018 |
| WO | WO 2019/036670 A1 | 2/2019 |
| WO | WO 2019/036682 A1 | 2/2019 |
| WO | WO 2019/036683 A1 | 2/2019 |
| WO | WO 2019/036685 A1 | 2/2019 |
| WO | WO 2019/081750 A1 | 5/2019 |
| WO | WO 2019/103993 A1 | 5/2019 |
| WO | WO 2019/148101 A1 | 8/2019 |
| WO | WO 2020/006242 A1 | 1/2020 |
| WO | WO 2020/056370 A1 | 3/2020 |
| WO | WO 2020/061284 A1 | 3/2020 |
| WO | WO 2020/061295 A1 | 3/2020 |
| WO | WO 2020/097291 A1 | 5/2020 |
| WO | WO 2020/163719 A2 | 8/2020 |
| WO | WO 2020/172239 A1 | 8/2020 |
| WO | WO 2020/185811 A1 | 9/2020 |
| WO | WO 2020/190750 A1 | 9/2020 |
| WO | WO 2020/243561 A1 | 12/2020 |
| WO | WO 2021/016430 A1 | 1/2021 |
| WO | WO 2021/030533 A1 | 2/2021 |
| WO | WO 2021/050864 A1 | 3/2021 |
| WO | WO 2021/055811 A1 | 3/2021 |
| WO | WO 2021/155243 A1 | 8/2021 |
| WO | WO 2021/159040 A2 | 8/2021 |
| WO | WO 2021/159130 A2 | 8/2021 |
| WO | WO 2021/204175 A1 | 10/2021 |
| WO | WO 2021/211343 A1 | 10/2021 |
| WO | WO 2021/222304 A1 | 11/2021 |
| WO | WO 2021/231929 A1 | 11/2021 |
| WO | WO 2021/231963 A1 | 11/2021 |
| WO | WO 2021/237084 A1 | 11/2021 |
| WO | WO 2021/239880 A1 | 12/2021 |
| WO | WO 2021/247817 A1 | 12/2021 |
| WO | WO 2022/009121 A1 | 1/2022 |
| WO | WO 2022/067010 A1 | 3/2022 |
| WO | WO 2022/076562 A1 | 4/2022 |
| WO | WO 2022/101469 A1 | 5/2022 |
| WO | WO 2022/150717 A1 | 7/2022 |
| WO | WO 2022/155524 A1 | 7/2022 |
| WO | WO 2022/155530 A1 | 7/2022 |

OTHER PUBLICATIONS

Anderson et al., Incorporation of pseudouridine into mRNA enhances translation by diminishing PKR activation, Nucleic Acids Res. Sep. 2010;38(17):5884-92. doi: 10.1093/nar/gkq347. Epub May 10, 2010.
Andries et al., N(1)-methylpseudouridine-incorporated mRNA outperforms pseudouridine-incorporated mRNA by providing enhanced protein expression and reduced immunogenicity in mammalian cell lines and mice. J Control Release. Nov. 10, 2015;217:337-44. doi: 10.1016/j.jconrel.2015.08.051. Epub Sep. 3, 2015.
Bahl et al., Preclinical and Clinical Demonstration of Immunogenicity by mRNA Vaccines against H10N8 and H7N9 Influenza Viruses. Mol Ther. Jun. 7, 2017;25(6):1316-1327. doi: 10.1016/j.ymthe.2017.03.035. Epub Apr. 27, 2017.
Bentebibel et al., ICOS(+)PD-1(+)CXCR3(+) T follicular helper cells contribute to the generation of high-avidity antibodies following influenza vaccination. Sci Rep. May 27, 2016;6:26494. doi: 10.1038/srep26494.
Bommakanti et al., Design of an HA2-based *Escherichia coli* expressed influenza immunogen that protects mice from pathogenic challenge. Proc Natl Acad Sci USA. Aug. 3, 2010;107(31):13701-6. doi: 10.1073/pnas.1007465107. Epub Jul. 6, 2010.
Bose et al., Influence of cationic lipid concentration on properties of lipid-polymer hybrid nanospheres for gene delivery. Int J Nanomedicine. Sep. 2, 2015;10:5367-82. doi: 10.2147/IJN.S87120. eCollection 2015.
Bowie et al., Deciphering the message in protein sequences: tolerance to amino acid substitutions. Science. Mar. 16, 1990;247(4948):1306-10.
Brito et al., A cationic nanoemulsion for the delivery of nextgeneration RNA vaccines. Mol Ther. Dec. 2014;22(12):2118-29. doi: 10.1038/mt.2014.133. Epub Jul. 16, 2014.
Chen et al., Clinical and epidemiological characteristics of a fatal case of avian influenza A H10N8 virus infection: a descriptive study. Lancet. Feb. 22, 2014;383(9918):714-21. doi: 10.1016/S0140-6736(14)60111-2. Epub Feb. 5, 2014.
Chen et al., Human monoclonal antibodies targeting the haemagglutinin glycoprotein can neutralize H7N9 influenza virus. Nat Commun. Mar. 30, 2015;6:6714. doi: 10.1038/ncomms7714.
Cheng et al., Multifunctional triblock copolymers for intracellular messenger RNA delivery. Biomaterials. Oct. 2012; 33(28): 6868-6876.
Cross, Without these lipid shells, there would be no mRNA vaccines for COVID-19. Chem Eng News. Mar. 6, 2021; 99(8). 4 pages.
Cu et al., Enhanced Delivery and Potency of Self-Amplifying mRNA Vaccines by Electroporation in Situ, Vaccines, 2013, 1, 367-383. Abstract Only.
Cullis et al., Lipid Nanoparticle Systems for Enabling Gene Therapies. Mol Ther. Jul. 5, 2017;25(7):1467-1475. doi: 10.1016/j.ymthe.2017.03.013. Epub Apr. 13, 2017.
Deering et al., Nucleic acid vaccines: prospects for non-viral delivery of mRNA vaccines.Expert Opin Drug Deliv. Jun. 2014;11(6):885-99. doi: 10.1517/17425247.2014.901308. Epub Mar. 26, 2014.
Dicaro et al., In Vivo Delivery of Nucleic Acid-Formulated Microparticles as a Potential Tolerogenic Vaccine for Type 1 Diabetes. Rev Diabet Stud. 2012 Winter;9(4):348-56.
Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015. Review.
Ernsting et al., Factors controlling the pharmacokinetics, biodistribution and intratumoral penetration of nanoparticles. J Control Release. Dec. 28, 2013;172(3):782-94. doi: 10.1016/j.jconrel.2013.09.013. Epub Sep. 25, 2013.
Feldman et al. mRNA vaccines against H10N8 and H7N9 influenza viruses of pandemic potential are immunogenic and well tolerated in healthy adults in phase 1 randomized clinical trials. Vaccine. May 31, 2019;37(25):3326-3334. doi: 10.1016/j.vaccine.2019.04.074. Epub May 10, 2019.
Fleeton et al., Self-replicative RNA vaccines elicit protection against influenza A virus, respiratory syncytial virus, and a tickborne encephalitis virus. J Infect Dis. May 1, 2001;183(9):1395-8. Epub Mar. 30, 2001.
Furuichi et al., Viral and cellular mRNA capping: past and prospects. Adv Virus Res. 2000;55:135-84. doi: 10.1016/s0065-3527(00)55003-9.
Furuichi, Caps on Eukaryotic mRNAs. eLS. John Wiley & Sons. Jul. 1-12, 2014.
Gao et al., Human infection with a novel avian-origin influenza A (H7N9) virus. N Engl J Med. May 16, 2013;368(20):1888-97. doi: 10.1056/NEJMoa1304459. Epub Apr. 11, 2013.
Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.
Gjetting et al., In vitro and in vivo effects of polyethylene glycol (PEG)-modified lipid in DOTAP/cholesterol-mediated gene transfection. Int J Nanomedicine. Aug. 9, 2010;5:371-83.

(56) References Cited

OTHER PUBLICATIONS

Hadinoto et al., Lipid-polymer Hybrid Nanoparticles as a New Generation Therapeutic Delivery Platform: A Review. Eur J Pharm Biopharm. Nov. 2013;85(3 Pt A):427-43. doi: 10.1016/j.ejpb.2013.07.002. Epub Jul. 17, 2013.

Hassett et al., Optimization of Lipid Nanoparticles for Intramuscular Administration of mRNA Vaccines. Mol Ther Nucleic Acids. 2019 Apr. 15,15:1-11. Epub Feb. 7, 2019.

Hekele et al., Rapidly produced SAM(®) vaccine against H7N9 influenza is immunogenic in mice. Emerg Microbes Infect. Aug. 2013;2(8):e52. doi: 10.1038/emi.2013.54. Epub Aug. 14, 2013.

Holtkamp et al., Modification of antigen-encoding RNA increases stability, translational efficacy, and T-cell stimulatory capacity of dendritic cells. Blood. Dec. 15, 2006;108(13):4009-17.

Hori et al., Antitumar Activity of Cationic Liposome-Mediated Bax mRNA Transfer in HOSM-1 Mandibular Osteoosarcoma Cells: A Comparative Study of Local Administraction and Systemic Administration. Journal of Oral and Maxillofacial Surgery, 2014, vol. 72, No. 9, SUPPL. 1, p. e107, Abstract No. 98.

Hsu et al., Cationic lipid nanoparticles for therapeutic delivery of siRNA and miRNA to murine liver tumor. Nanomedicine. Nov. 2013;9(8):1169-80. doi: 10.1016/j.nano.2013.05.007. Epub May 30, 2013.

Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.

Kauffman et al., Efficacy and immunogenicity of unmodified and pseudouridine-modified mRNA delivered systemically with lipid nanoparticles in vivo. Biomaterials. Dec. 2016;109:78-87. doi: 10.1016/j.biomaterials.2016.09.006. Epub Sep. 25, 2016.

Kauffman et al., Materials for non-viral intracellular delivery of messenger RNA therapeutics. J Control Release. Oct. 28, 2016;240:227-234. doi: 10.1016/j.jconrel.2015.12.032. Epub Dec. 21, 2015.

Khurana et al., Recombinant HA1 produced in *E. coli* forms functional oligomers and generates strain-specific SRID potency antibodies for pandemic influenza vaccines. Vaccine. Aug. 5, 2011;29(34):5657-65. doi: 10.1016/j.vaccine.2011.06.014. Epub Jun. 23, 2011.

Knepper et al., The novel human influenza A(H7N9) virus is naturally adapted to efficient growth in human lung tissue. MBio. Oct. 8, 2013;4(5):e00601-13. doi: 10.1128/mBio.00601-13.

Kopera et al., Expression, purification and characterization of glycosylated influenza H5N1 hemagglutinin produced in Pichia pastoris. Acta Biochim Pol. 2014;61(3):597-602. Epub Sep. 12, 2014.

Kowalski et al., Delivering the Messenger: Advances in Technologies for Therapeutic mRNA Delivery. Molecular Therapy vol. 27 No. 4 Apr. 2019.

Kuhn et al., mRNA as a versatile tool for exogenous protein expression. Current Gene Therapy. Oct. 2012; 12 (5): 347-361.

Kulkarni et al., Lipid Nanoparticles Enabling Gene Therapies: From Concepts to Clinical Utility. Nucleic Acid Ther. Jun. 2018;28(3):146-157. doi: 10.1089/nat.2018.0721. Epub Apr. 23, 2018.

Kumar et al., Shielding of Lipid Nanoparticles for siRNA Delivery: Impact on Physicochemical Properties, Cytokine Induction, and Efficacy. Mol Ther Nucleic Acids. Nov. 18, 2014;3(11):e210. doi: 10.1038/mtna.2014.61.

Kurimoto et al., PEG-OligoRNA Hybridization of mRNA for Developing Sterically Stable Lipid Nanoparticles toward In Vivo Administration. Molecules. Apr. 3, 2019;24(7):1303. doi: 10.3390/molecules24071303.

Leitner et al., DNA and RNA-based vaccines: principles, progress and prospects. Vaccine. Dec. 10, 1999;18 (9-10):765-77.

Leroueil et al., Wide varieties of cationic nanoparticles induce defects in supported lipid bilayers. Nano Lett. Feb. 2008;8(2):420-4. doi: 10.1021/nl0722929. Epub Jan. 25, 2008.

Li et al., Developing lipid nanoparticle-based siRNA therapeutics for hepatocellular carcinoma using an integrated approach. Mol Cancer Ther. Nov. 2013;12(11):2308-18. doi: 10.1158/1535-7163.MCT-12-0983-T. Epub Aug. 13, 2013.

Li et al., Prophylactic, therapeutic and immune enhancement effect of liposome-encapsulated PolyICLC on highly pathogenic H5N1 influenza infection. J Gene Med. Jan. 2011;13(1):60-72. doi: 10.1002/jgm.1536.

Lian et al., Trends and developments in liposome drug delivery systems. J Pharm Sci. Jun. 2001;90(6):667-80.

Liang et al., Efficient Targeting and Activation of Antigen-Presenting Cells In Vivo after Modified mRNA Vaccine Administration in Rhesus Macaques. Mol Ther. Dec. 6, 2017;25(12):2635-2647. doi: 10.1016/j.ymthe.2017.08.006. Epub Aug. 12, 2017.

Lindgren et al., Induction of Robust B Cell Responses after Influenza mRNA Vaccination Is Accompanied by Circulating Hemagglutinin-Specific ICOS+ PD-1+ CXCR3+ T Follicular Helper Cells. Front Immunol. Nov. 13, 2017;8:1539. doi: 10.3389/fimmu.2017.01539. eCollection 2017.

Lorenzi et al., Intranasal vaccination with messenger RNA as a new approach in gene therapy: Use against tuberculosis. BMC Biotechnol. Oct. 2010; 10(77): 1-11.

Maclachlan, Lipid Nanoparticle-mediated delivery of messenger RNA. Presentation. 1st International mRNA Health Conference. Tubingen, Germany. Oct. 24, 2013. http://files.shareholder.com/downloads/ABEA-50QJTB/2628241206xQx699789/47543dl2-db34-4e6e-88a9-f3ae5d97bld2/MacLachlan_mRNA_Conf_2013.pdf. Last accessed Dec. 22, 2016.

Madden et al., Systemic delivery of mRNA therapeutics using lipid nanoparticles (LNP): improved potency for novel LNP and influence of route of administration on protein expression. 2nd International mRNA Health Conference. Nov. 12, 2014. https://acuitastx.com/wp-content/uploads/2015/01/Poster-Second-International-mRNA-Health-Conference.pdf. 1 page.

Magini et al., Self-Amplifying mRNA Vaccines Expressing Multiple Conserved Influenza Antigens Confer Protection against Homologous and Heterosubtypic Viral Challenge. PLoS One. Aug. 15, 2016;11(8):e0161193. doi: 10.1371/journal.pone.0161193. eCollection 2016.

Martinon et al., Induction of virus-specific cytotoxic T lymphocytes in vivo by liposome-entrapped mRNA. EurJ Immunol. Jul. 1993;23(7):1719-22.

McKenzie et al., Nucleic acid vaccines: tasks and tactics. Immunol Res. 2001 ;24(3):225-44.

Midoux et al., Lipid-based mRNA vaccine delivery systems. Expert Rev Vaccines. Feb. 2015;14(2):221-34. doi: 10.1586/14760584.2015.986104. Epub Dec. 26, 2014. Review.

Mitchell et al., RNA transfected dendritic cells as cancer vaccines. Curr Opin Mol Ther. Apr. 2000;2(2):176-81.

Mockey et al., mRNA-based cancer vaccine: prevention of B16 melanoma progression and metastasis by systemic injection of MARTI mRNA histidylated lipopolyplexes. Cancer Gene Ther. Sep. 2007;14(9):802-14. Epub Jun. 22, 2007.

Munster et al., Hemagglutinin [Influenza A virus (A/mallard/Sweden/91/2002(H7N9))]. GenBank: AAY46211.1. Pep. Sep. 30, 2005.
Pardi et al., Developing an influenza vaccine using lipid nanoparticle-encapsulated nucleoside-modified mRNA. Eur. J. Immunol. Aug. 2016.;46(S1):1232-1233. Abstract 1349.
Pardi et al., Expression Kinetics of Nucleoside-Modified mRNA Delivered in Lipid Nanoparticles to Mice by Various Routes. J Control Release. Nov. 10, 2015;217:345-51. doi: 10.1016/j.jconrel.2015.08.007. Epub Aug. 8, 2015.
Pardi et al., mRNA vaccines—a new era in vaccinology. Nat Rev Drug Discov. Apr. 2018;17(4):261-279. doi: 10.1038/nrd.2017.243. Epub Jan. 12, 2018.
Pardi et al., Nucleoside-modified mRNA vaccines induce potent T follicular helper and germinal center B cell responses. J Exp Med. Jun. 4, 2018;215(6):1571-1588. doi: 10.1084/jem.20171450. Epub May 8, 2018.
Petsch et al., Protective efficacy of in vitro synthesized, specific mRNA vaccines against influenza A virus infection. Nat Biotechnol. Dec. 2012;30(12):1210-6. doi: 10.1038/nbt.2436. Epub Nov. 25, 2012.

(56) References Cited

OTHER PUBLICATIONS

Pollard et al., Type I IFN counteracts the induction of antigen-specific immune responses by lipid-based delivery of mRNA vaccines. Mol Ther. Jan. 2013; 21 (1): 251-259.
Poveda et al., Establishing Preferred Product Characterization for the Evaluation of RNA Vaccine Antigens. Vaccines (Basel). Sep. 27, 2019;7(4):131. doi: 10.3390/vaccines7040131.
Reichmuth et al., mRNA Vaccine Delivery Using Lipid Nanoparticles. Ther Deliv. 2016;7(5):319-34. doi: 10.4155/tde-2016-0006.
Sayour et al., RNA Nanoparticle Vaccines Facilitate and Sutain Adoptive Cellular Therapy Targeting Pediatric Intracranial Malignancies. Pediatric Blood and Cancer, Jun. 2015, vol. 62, Supplement 2, p. S24, Abstract No. 4012.
Sabnis et al., A Novel Amino Lipid Series for mRNA Delivery: Improved Endosomal Escape and Sustained Pharmacology and Safety in Non-human Primates. Mol Ther. Jun. 6, 2018;26(6):1509-1519. doi: 10.1016/j.ymthe.2018.03.010. Epub Mar. 14, 2018.
Schirrmacher et al., Intra-pinna anti-tumor vaccination with self-replicating infectious RNA or with DNA encoding a model tumor antigen and a cytokine. Gene Ther. Jul. 2000;7(13):1137-47.
Schlake et al., Developing mRNA-vaccine technologies. RNA Biol. Nov. 2012;9(11):1319-30. doi: 10.4161/rna.22269. Epub Oct. 12, 2012.
Schott et al., Viral and non-viral approaches for transient delivery of mRNA and proteins. Current Gene Ther. 2011; 11 (5): 382-398.
Schwendener, Liposomes as vaccine delivery systems: a review of the recent advances. Ther Adv Vaccines. Nov. 2014;2(6):159-82. doi: 10.1177/2051013614541440.
Shin et al., Recent Advances in RNA Therapeutics and RNA Delivery Systems Based on Nanoparticles. Adv. Therap., Nov. 2018;1(7):1800065. Review.
Sirin et al. AB-Bind: Antibody binding mutational database for computational affinity predictions. Protein Sci. Feb. 2016;25(2):393-409. doi: 10.1002/pro.2829. Epub Nov. 6, 2015.
Stab et al., Protective efficacy and immunogenicity of a combinatory DNA vaccine against Influenza A Virus and the Respiratory Syncytial Virus. PLoS One. Aug. 14, 2013;8(8):e72217. doi: 10.1371/journal.pone.0072217. eCollection 2013.
Szebeni et al., Activation of complement by therapeutic liposomes and other lipid excipient-based therapeutic products: prediction and prevention. Adv Drug Deliv Rev. Sep. 16, 2011;63(12):1020-30. doi: 10.1016/j.addr.2011.06.017. Epub Jul. 14, 2011.
Szebeni et al., Complement activation as a bioequivalence issue relevant to the development of generic liposomes and other nanoparticulate drugs. Biochem Biophys Res Commun. Dec. 18, 2015;468(3):490-7. doi: 10.1016/j.bbrc.2015.06.177. Epub Jul. 14, 2015.
Szebeni, Complement activation-related pseudoallergy: a stress reaction in blood triggered by nanomedicines and biologicals. Mol Immunol. Oct. 2014;61(2):163-73. doi: 10.1016/j.molimm.2014.06.038. Epub Aug. 12, 2014.
Terada et al., Characterization of Lipid Nanoparticles Containing Ionizable Cationic Lipids Using Design-of-Experiments Approach. Langmuir. Jan. 26, 2021;37(3):1120-1128. doi: 10.1021/acs.langmuir.0c03039. Epub Jan. 13, 2021.
Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.
Torrecilla et al., Lipid Nanoparticles as Carriers for RNAi Against Viral Infections: Current Status and Future Perspectives. Biomed Res Int. 2014;2014:161794. doi: 10.1155/2014/161794. Epub Aug. 12, 2014.
Vassilev et al., Microparticle-mediated RNA immunization against bovine viral diarrhea virus. Vaccine. Feb. 28, 2001;19(15-16):2012-9.
Wang et al., Hemagglutinin (HA) proteins from H1 and H3 serotypes of influenza A viruses require different antigen designs for the induction of optimal protective antibody responses as studied by codon-optimized HA DNA vaccines. J Virol. Dec. 2006;80(23):11628-37. Epub Sep. 20, 2006.
Wang et al., Systemic delivery of modified mRNA encoding herpes simplex virus 1 thymidine kinase for targeted cancer gene therapy. Mol Ther. Feb. 2013;21(2):358-67. doi:10.1038/mt.2012.250. Epub Dec. 11, 2012.
Weilhammer et al., The use of nanolipoprotein particles to enhance the immunostimulatory properties of innate immune agonists against lethal influenza challenge. Biomaterials. Dec. 2013;34(38):10305-18. doi: 10.1016/j.biomaterials.2013.09.038. Epub Sep. 27, 2013.
Wentworth et al., Hemagglutinin [Influenza A virus (A/Anhui/DEWH72-01/2013(H7N9))]. Gen Bank: AHZ39686.1.Dep. May 9, 2014.
Winkler et al., Changing the antigen binding specificity by single point mutations of an anti-p24 (HIV-1) antibody. J Immunol. Oct. 15, 2000;165(8):4505-14.
Wong et al., An mRNA vaccine for influenza. Nat Biotechnol. Dec. 2012;30(12):1202-4. doi: 10.1038/nbt.2439.
Xue et al., Lipid-Based Nanocarriers for RNA Pelivery. Curr Pharm Pes. 2015;21(22):3140-7.
Yamamoto et al., Current prospects for mRNA gene delivery. Eur J Pharm Biopharm. Mar. 2009;71(3):484-9. doi: 10.1016/j.ejpb.2008.09.016. Epub Oct. 10, 2008.
Ying et al., Cancer therapy using a self-replicating RNA vaccine. Nat Med. Jul. 1999;5(7):823-7.
Ze et al., Identification of effective constituents of influenza vaccine by immunization with plasmid DNAs encoding viral proteins. Jpn J Infect Dis. Dec. 2000;53(6):219-28.
Zhang et al., Construction of eukaryotic expressing plasmids encoding HA and HA1 of influenza A virus and their transient expression in HEK293 cells. J Huazhong Univ Sci Technolog Med Sci. 2006;26(2):225-7, 230.
Zhao et al., Nanoparticle vaccines. Vaccine. Jan. 9, 2014;32(3):327-37. doi: 10.1016/j.vaccine.2013.11.069. Epub Dec. 2, 2013.
Maruggi et al., mRNA as a Transformative Technology for Vaccine Development to Control Infectious Diseases. Mol Ther. Apr. 10, 2019;27(4):757-772. doi: 10.1016/j.ymthe.2019.01.020. Epub Feb. 7, 2019.
Patel et al., Naturally-occuring cholesterol analogues in lipid nanoparticles induce polymorphic shape and enhance intracellular delivery of mRNA. Nat Commun. Feb. 20, 2020;11(1):983. doi: 10.1038/s41467-020-14527-2.
Woodle et al., Sterically stabilized liposomes. Biochim Biophys Acta. Aug. 14, 1992;1113(2):171-99. doi: 10.1016/0304-4157(92)90038-c.
Zeng et al., Formulation and Delivery Technologies for mRNA Vaccines. Curr Top Microbiol Immunol. Jun. 2, 2020;10.1007/82_2020_217. doi: 10.1007/82_2020_217.
U.S. Appl. No. 17/683,171, filed Feb. 28, 2022, Ciaramella et al.
U.S. Appl. No. 17/554,182, filed Dec. 17, 2021, Ciaramella et al.
U.S. Appl. No. 17/819,414, filed Aug. 12, 2022, Ciaramella.
U.S. Appl. No. 17/590,479, filed Feb. 1, 2022, Ciaramella et al.
U.S. Appl. No. 17/737,532, filed May 5, 2022, Ciaramella et al.
U.S. Appl. No. 17/583,674, filed Jan. 25, 2022, Besin et al.
U.S. Appl. No. 17/523,034, filed Nov. 10, 2021, Hoge et al.
U.S. Appl. No. 17/523,060, filed Nov. 10, 2021, Hoge et al.
U.S. Appl. No. 17/548,172, filed Dec. 10, 2021, Ciaramella et al.
U.S. Appl. No. 17/839,401, filed Jun. 13, 2022, Ciaramella et al.
U.S. Appl. No. 17/830,742, filed Jun. 2, 2022, Miracco.
U.S. Appl. No. 17/852,974, filed Jun. 29, 2022, Marquardt et al.
U.S. Appl. No. 17/823,255, filed Aug. 30, 2022, Ciaramella et al.
U.S. Appl. No. 17/531,211, filed Nov. 19, 2021, Ciaramella et al.
U.S. Appl. No. 17/634,939, filed Feb. 11, 2022, Shamashkin et al.
U.S. Appl. No. 17/816,696, filed Aug. 1, 2022, Dousis et al.
U.S. Appl. No. 17/737,581, filed May 5, 2022, Panther et al.
U.S. Appl. No. 17/761,420, filed Mar. 17, 2022, Amato et al.
U.S. Appl. No. 17/615,202, filed Nov. 30, 2021, Hopson.
U.S. Appl. No. 17/641,967, filed Mar. 10, 2022, John et al.
U.S. Appl. No. 17/840,478, filed Jun. 14, 2022, Kramarczyk et al.
U.S. Appl. No. 17/796,401, filed Jul. 29, 2022, Shaw et al.
U.S. Appl. No. 17/518,542, filed Nov. 3, 2021, Metkar et al.
U.S. Appl. No. 17/796,208, filed Jul. 28, 2022, Stewart-Jones et al.

(56) References Cited

OTHER PUBLICATIONS

U.S. Appl. No. 17/797,784, U.S. Appl. No. 17/797,784, Stewart-Jones et al.
U.S. Appl. No. 17/572,465, filed Jan. 10, 2022, Nachbagauer et al.
U.S. Appl. No. 17/726,971, filed Apr. 22, 2022, Hennessy.
[No Author Listed]: "Moderna's (MRNA) Flu Vaccine Data Fails to Impress Investors", Dec. 13, 2021 (Dec. 13, 2021), XP055900454, Retrieved from the Internet: URL:https://finance.yahoo.com/news/moderna s-mrna-flu-vaccine-data-153303228.html?guccounter=1&zguce_referrer=aHROcHM6Ly93d3cuZ29vZ2xlLmNvbS8&guce_referrer_sig=AQAAAJpn3p7IiHi5Gppdr9ckD_a8FxRTr2MtUAQeqDz37PFJp8H_QTbC2SK Oslbb28wvm7kJTQ JcRAdYVNfcXSBAeWKrKRY4HMdkSZGaWdx2fMpYlwKaeGu c4iW6N8k-60f8R7YT HZilNunaCU.
Dolgin, mRNA flu shots move into trials. Nature Reviews Drug Discovery 20, 801-803 (2021).
Krammer et al., Chimeric hemagglutinin influenza virus vaccine constructs elicit broadly protective stalk-specific antibodies. J Virol. Jun. 2013;87(12):6542-50. doi: 10.1128/JVI.00641-13. Epub Apr. 10, 2013.
Li et al., Lipid-based nanoparticles for nucleic acid delivery. Pharm Res. Mar. 2007;24(3):438-49. doi: 10.1007/s11095-006-9180-5.
U.S. Appl. No. 16/036,318, filed Jul. 16, 2018, Ciaramella et al.
U.S. Appl. No. 16/144,394, filed Sep. 27, 2018, Ciaramella et al.
U.S. Appl. No. 17/204,801, filed Mar. 17, 2021, Ciaramella et al.
U.S. Appl. No. 15/748,773, filed Jan. 30, 2018, Ciaramella et al.
U.S. Appl. No. 15/753,293, filed Feb. 17, 2018, Smith.
U.S. Appl. No. 15/767,587, filed Apr. 11, 2018, Ciaramella.
U.S. Appl. No. 16/833,409, filed Mar. 27, 2020, Ciaramella.
U.S. Appl. No. 15/767,600, filed Apr. 11, 2018, Ciaramella et al.
U.S. Appl. No. 15/769,710, filed Apr. 19, 2018, Ciaramella et al.
U.S. Appl. No. 15/767,609, filed Apr. 11, 2018, Ciaramella et al.
U.S. Appl. No. 15/767,613, filed Apr. 11, 2018, Ciaramella et al.
U.S. Appl. No. 15/767,618, filed Apr. 11, 2018, Ciaramella et al.
U.S. Appl. No. 16/853,973, filed Apr. 21, 2020, Ciaramella et al.
U.S. Appl. No. 16/850,519, filed Apr. 16, 2020, Ciaramella et al.
U.S. Appl. No. 16/897,859, filed Jun. 10, 2020, Ciaramella et al.
U.S. Appl. No. 16/898,268, filed Jun. 10, 2020, Ciaramella et al.
U.S. Appl. No. 16/599,661, filed Oct. 11, 2019, Besin et al.
U.S. Appl. No. 16/333,330, filed Mar. 14, 2019, Hoge et al.
U.S. Appl. No. 16/864,566, filed May 1, 2020, Ciaramella et al.
U.S. Appl. No. 16/897,734, filed Jun. 10, 2020, Ciaramella et al.
U.S. Appl. No. 16/468,838, filed Jun. 12, 2019, Miracco.
U.S. Appl. No. 16/001,765, filed Jun. 6, 2018, Marquardt et al.
U.S. Appl. No. 17/127,949, filed Dec. 18, 2020, Ciaramella.
U.S. Appl. No. 17/385,655, filed Jul. 26, 2021, Ciaramella et al.
U.S. Appl. No. 16/603,111, filed Oct. 4, 2019, Brito et al.
U.S. Appl. No. 16/482,844, filed Aug. 1, 2019, Valiante et al.
U.S. Appl. No. 16/496,135, filed Sep. 20, 2019, Narayanan et al.
U.S. Appl. No. 16/483,012, filed Aug. 1, 2019, Mauger et al.
U.S. Appl. No. 17/350,662, filed Jun. 17, 2021, Rabideau et al.
U.S. Appl. No. 16/362,366, filed Mar. 22, 2019, Ciaramella.
U.S. Appl. No. 16/494,130, filed Sep. 13, 2019, Ciaramella et al.
U.S. Appl. No. 16/494,103, filed Sep. 13, 2019, Ciaramella et al.
U.S. Appl. No. 17/245,973, filed Apr. 30, 2021, Ciaramella.
U.S. Appl. No. 16/494,988, filed Sep. 17, 2019, Ciaramella et al.
U.S. Appl. No. 17/155,592, filed Jan. 22, 2021, Ciaramella et al.
U.S. Appl. No. 16/639,265, filed Feb. 14, 2020, Issa et al.
U.S. Appl. No. 16/639,305, filed Feb. 14, 2020, Issa et al.
U.S. Appl. No. 16/765,285, filed May 19, 2020, Ciaramella et al.
U.S. Appl. No. 16/302,607, filed Nov. 16, 2018, Benenato et al.
U.S. Appl. No. 16/623,069, filed Dec. 16, 2019, Hoge et al.
U.S. Appl. No. 16/639,403, filed Feb. 14, 2020, Hoge et al.
U.S. Appl. No. 16/848,318, filed Apr. 14, 2020, Ciaramella et al.
U.S. Appl. No. 16/965,589, filed Jul. 28, 2020, Ciaramella et al.
U.S. Appl. No. 17/255,949, filed Dec. 23, 2020, Zhong et al.
U.S. Appl. No. 17/277,423, filed Mar. 18, 2021, Almarsson et al.
U.S. Appl. No. 17/277,452, filed Mar. 18, 2021, Hennessy et al.
U.S. Appl. No. 17/276,112, filed Mar. 12, 2021, Martini et al.
U.S. Appl. No. 17/438,049, filed Sep. 10, 2021, Elich et al.
U.S. Appl. No. 17/291,947, filed May 6, 2021, Ashburn et al.
U.S. Appl. No. 17/439,198, filed Sep. 14, 2021, Lusso et al.
U.S. Appl. No. 17/325,883, filed May 20, 2021, Dousis et al.
U.S. Appl. No. 16/788,182, filed Feb. 11, 2020, Panther et al.
U.S. Appl. No. 16/794,318, filed Feb. 19, 2020, Mauger et al.
U.S. Appl. No. 17/145,164, filed Jan. 8, 2021, Giessel et al.
U.S. Appl. No. 17/411,896, filed Aug. 25, 2021, Kramarczyk et al.
U.S. Appl. No. 17/000,215, filed Aug. 21, 2020, Stewart-Jones et al.
PCT/US2018/022605, Aug. 7, 2018, International Search Report and Written Opinion.

\* cited by examiner

BROAD SPECTRUM INFLUENZA VIRUS VACCINE

RELATED APPLICATIONS

This application is a national stage filing under 35 U.S.C. § 371 of international application number PCT/US2018/022605, filed Mar. 15, 2018, which was published under PCT Article 21(2) in English and claims the benefit under 35 U.S.C. § 119(e) of U.S. provisional application No. 62/471,771, filed Mar. 15, 2017, and U.S. provisional application No. 62/490,057, filed Apr. 26, 2017, each of which is incorporated by reference herein in its entirety.

BACKGROUND

Influenza viruses are members of the orthomyxoviridae family, and are classified into three distinct types (A, B, and C), based on antigenic differences between their nucleoprotein (NP) and matrix (M) protein. The orthomyxoviruses are enveloped animal viruses of approximately 100 nm in diameter. The influenza virions consist of an internal ribonucleoprotein core (a helical nucleocapsid) containing a single-stranded RNA genome, and an outer lipoprotein envelope lined inside by a matrix protein (M1). The segmented genome of influenza A virus consists of eight molecules (seven for influenza C virus) of linear, negative polarity, single-stranded RNAs, which encode several polypeptides including: the RNA-directed RNA polymerase proteins (PB2, PB1 and PA) and nucleoprotein (NP), which form the nucleocapsid; the matrix proteins (M1, M2, which is also a surface-exposed protein embedded in the virus membrane); two surface glycoproteins, which project from the lipoprotein envelope: hemagglutinin (HA) and neuraminidase (NA); and nonstructural proteins (NS1 and NS2). Transcription and replication of the genome takes place in the nucleus and assembly takes place at the plasma membrane.

Hemagglutinin is the major envelope glycoprotein of influenza A and B viruses, and hemagglutinin-esterase (HE) of influenza C viruses is a protein homologous to HA. The rapid evolution of the HA protein of the influenza virus results in the constant emergence of new strains, rendering the adaptive immune response of the host only partially protective to new infections. The biggest challenge for therapy and prophylaxis against influenza and other infections using traditional vaccines is the limitation of vaccines in breadth, providing protection only against closely related subtypes. In addition, the length of time required to complete current standard influenza virus vaccine production processes inhibits the rapid development and production of an adapted vaccine in a pandemic situation.

Deoxyribonucleic acid (DNA) vaccination is one technique used to stimulate humoral and cellular immune responses to foreign antigens, such as influenza antigens. The direct injection of genetically engineered DNA (e.g., naked plasmid DNA) into a living host results in a small number of its cells directly producing an antigen, resulting in a protective immunological response. With this technique, however, come potential problems, including the possibility of insertional mutagenesis, which could lead to the activation of oncogenes or the inhibition of tumor suppressor genes.

SUMMARY

Provided herein is a ribonucleic acid (RNA) vaccine (or a composition or an immunogenic composition) that builds on the knowledge that RNA (e.g., messenger RNA (mRNA)) can safely direct the body's cellular machinery to produce nearly any protein of interest, from native proteins to antibodies and other entirely novel protein constructs that can have therapeutic activity inside and outside of cells. The RNA vaccines of the present disclosure may be used to induce a balanced immune response against influenza virus, comprising both cellular and humoral immunity, without risking the possibility of insertional mutagenesis, for example.

The RNA (e.g., mRNA) vaccines may be utilized in various settings depending on the prevalence of the infection or the degree or level of unmet medical need. The RNA vaccines may be utilized to treat and/or prevent an influenza virus of various genotypes, strains, and isolates. The RNA vaccines typically have superior properties in that they produce much larger antibody titers and produce responses earlier than commercially available anti-viral therapeutic treatments. While not wishing to be bound by theory, it is believed that the RNA vaccines, as mRNA polynucleotides, are better designed to produce the appropriate protein conformation upon translation as the RNA vaccines co-opt natural cellular machinery. Unlike traditional vaccines, which are manufactured ex vivo and may trigger unwanted cellular responses, RNA (e.g., mRNA) vaccines are presented to the cellular system in a more native fashion.

There may be situations where persons are at risk for infection with more than one strain of influenza virus. RNA (e.g., mRNA) therapeutic vaccines are particularly amenable to combination vaccination approaches due to a number of factors including, but not limited to, speed of manufacture, ability to rapidly tailor vaccines to accommodate perceived geographical threat, and the like. Moreover, because the vaccines utilize the human body to produce the antigenic protein, the vaccines are amenable to the production of larger, more complex antigenic proteins, allowing for proper folding, surface expression, antigen presentation, etc. in the human subject. To protect against more than one strain of influenza, a combination vaccine can be administered that includes RNA (e.g., mRNA) encoding at least one antigenic polypeptide protein (or antigenic portion thereof) of a first influenza virus or organism and further includes RNA encoding at least one antigenic polypeptide protein (or antigenic portion thereof) of a second influenza virus or organism. RNA (e.g., mRNA) can be co-formulated, for example, in a single lipid nanoparticle (LNP) or can be formulated in separate LNPs for co-administration.

Some embodiments of the present disclosure provide influenza virus (influenza) vaccines (or compositions or immunogenic compositions) that include at least one RNA polynucleotide having an open reading frame encoding at least one influenza antigenic polypeptide.

In some embodiments, the at least one antigenic polypeptide is one of the defined antigenic subdomains of HA, termed HA1, HA2, or a combination of HA1 and HA2, and at least one antigenic polypeptide selected from neuraminidase (NA), nucleoprotein (NP), matrix protein 1 (M1), matrix protein 2 (M2), non-structural protein 1 (NS1) and non-structural protein 2 (NS2).

In some embodiments, the at least one antigenic polypeptide is HA or derivatives thereof comprising antigenic sequences from HA1 and/or HA2, and at least one antigenic polypeptide selected from NA, NP, M1, M2, NS1 and NS2.

In some embodiments, the at least one antigenic polypeptide is HA or derivatives thereof comprising antigenic sequences from HA1 and/or HA2 and at least two antigenic polypeptides selected from NA, NP, M1, M2, NS1 and NS2.

In some embodiments, a vaccine comprises at least one RNA (e.g., mRNA) polynucleotide having an open reading frame encoding an influenza virus protein.

In some embodiments, a vaccine comprises at least one RNA (e.g., mRNA) polynucleotide having an open reading frame encoding multiple influenza virus proteins.

In some embodiments, a vaccine comprises at least one RNA (e.g., mRNA) polynucleotide having an open reading frame encoding a HA protein (e.g., at least one HA1, HA2, or a combination of both).

In some embodiments, a vaccine comprises at least one RNA (e.g., mRNA) polynucleotide having an open reading frame encoding a HA protein (e.g., at least one HA1, HA2, or a combination of both, of any one of or a combination of any or all of H1, H2, H3, H4, H5, H6, H7, H8, H9, H10, H11, H12, H13, H14, H15, H16, H17, and/or H18) and at least one other RNA (e.g., mRNA) polynucleotide having an open reading frame encoding a protein selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one any one of or a combination of any or all of H1, H2, H3, H4, H5, H6, H7, H8, H9, H10, H11, H12, H13, H14, H15, H16, H17, and/or H18) and at least two other RNAs (e.g., mRNAs) polynucleotides having two open reading frames encoding two proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of any one of or a combination of any or all of H1, H2, H3, H4, H5, H6, H7, H8, H9, H10, H11, H12, H13, H14, H15, H16, H17, and/or H18) and at least three other RNAs (e.g., mRNAs) polynucleotides having three open reading frames encoding three proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of any one of or a combination of any or all of H1, H2, H3, H4, H5, H6, H7, H8, H9, H10, H11, H12, H13, H14, H15, H16, H17, and/or H18) and at least four other RNAs (e.g., mRNAs) polynucleotides having four open reading frames encoding four proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of any one of or a combination of any or all of H1, H2, H3, H4, H5, H6, H7, H8, H9, H10, H11, H12, H13, H14, H15, H16, H17, and/or H18) and at least five other RNAs (e.g., mRNAs) polynucleotides having five open reading frames encoding five proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of any one of or a combination of any or all of H1, H2, H3, H4, H5, H6, H7, H8, H9, H10, H11, H12, H13, H14, H15, H16, H17, and/or H18), a NP protein, a NA protein, a M1 protein, a M2 protein, a NS1 protein and a NS2 protein obtained from influenza virus.

Some embodiments of the present disclosure provide the following novel influenza virus polypeptide sequences: H1HA10-Foldon_ΔNgly1; H1HA10TM-PR8 (H1 A/Puerto Rico/8/34 HA); H1HA10-PR8-DS (H1 A/Puerto Rico/8/34 HA; pH1HA10-Cal04-DS (H1 A/California/04/2009 HA); Pandemic H1HA10 from California 04; pH1HA10-ferritin; HA10; Pandemic H1HA10 from California 04; Pandemic H1HA10 from California 04 strain/without foldon and with K68C/R76C mutation for trimerization; H1HA10 from A/Puerto Rico/8/34 strain, without foldon and with Y94D/N95L mutation for trimerization; H1HA10 from A/Puerto Rico/8/34 strain, without foldon and with K68C/R76C mutation for trimerization; H1N1 A/Viet Nam/850/2009; H3N2 A/Wisconsin/67/2005; H7N9 (A/Anhui/1/2013); H9N2 A/Hong Kong/1073/99; H10N8 A/JX346/2013.

Some embodiments of the present disclosure provide influenza virus (influenza) vaccines that include at least one RNA polynucleotide having an open reading frame encoding at least one influenza antigenic polypeptide. In some embodiments, an influenza vaccine comprises at least one RNA (e.g., mRNA) polynucleotide having an open reading frame encoding at least one influenza antigenic polypeptide comprising a modified sequence that is at least 75% (e.g., any number between 75% and 100%, inclusive, e.g., 70%, 80%, 85%, 90%, 95%, 99%, and 100%) identity to an amino acid sequence of the novel influenza virus sequences described above. The modified sequence can be at least 75% (e.g., any number between 75% and 100%, inclusive, e.g., 70%, 80%, 85%, 90%, 95%, 99%, and 100%) identical to an amino acid sequence of the novel influenza virus sequences described above.

Some embodiments of the present disclosure provide an isolated nucleic acid comprising a sequence encoding the novel influenza virus polypeptide sequences described above; an expression vector comprising the nucleic acid; and a host cell comprising the nucleic acid. The present disclosure also provides a method of producing a polypeptide of any of the novel influenza virus sequences described above. A method may include culturing the host cell in a medium under conditions permitting nucleic acid expression of the novel influenza virus sequences described above, and purifying from the cultured cell or the medium of the cell a novel influenza virus polypeptide. The present disclosure also provides antibody molecules, including full length antibodies and antibody derivatives, directed against the novel influenza virus sequences.

In some embodiments, an open reading frame of a RNA (e.g., mRNA) vaccine is codon-optimized. In some embodiments, at least one RNA polynucleotide encodes at least one antigenic polypeptide comprising an amino acid sequence identified by any one of SEQ ID NO: 1-444, 458, 460, 462-479, or 543-565 (see also Tables 7-13 and 26) and is codon optimized mRNA.

In some embodiments, a RNA (e.g., mRNA) vaccine further comprising an adjuvant.

Tables 7-13 provide National Center for Biotechnology Information (NCBI) accession numbers of interest. It should be understood that the phrase "an amino acid sequence of Tables 7-13" refers to an amino acid sequence identified by one or more NCBI accession numbers listed in 7-13. Each of the amino acid sequences, and variants having greater than 95% identity or greater than 98% identity to each of the amino acid sequences encompassed by the accession numbers of Tables 7-13 are included within the constructs (polynucleotides/polypeptides) of the present disclosure.

In some embodiments, at least one mRNA polynucleotide is encoded by a nucleic acid comprising a sequence identified by any one of SEQ ID NO: 447-457, 459, 461, 505-523, or 570-573 and having less than 80% identity to wild-type mRNA sequence. In some embodiments, at least one mRNA polynucleotide is encoded by a nucleic acid comprising a sequence identified by any one SEQ ID NO: 447-457, 459, 461, 505-523, or 570-573 and having less than 75%, 85% or 95% identity to a wild-type mRNA sequence. In some embodiments, at least one mRNA polynucleotide is encoded by nucleic acid comprising a sequence identified by any one of SEQ ID NO: 447-457, 459, 461, 505-523, or 570-573 and having less than 50-80%, 60-80%, 40-80%, 30-80%, 70-80%, 75-80% or 78-80% identity to wild-type mRNA sequence. In some embodiments, at least one mRNA polynucleotide is encoded by a nucleic acid comprising a sequence identified by any one of SEQ ID NO: 447-457, 459, 461, 505-523, or 570-573 and having less than 40-85%, 50-85%, 60-85%, 30-85%, 70-85%, 75-85% or 80-85% identity to wild-type mRNA sequence. In some embodiments, at least one mRNA polynucleotide is encoded by a nucleic acid comprising a sequence identified by any one of SEQ ID NO: 447-457, 459, 461, 505-523, or 570-573 and having less than 40-90%, 50-90%, 60-90%, 30-90%, 70-90%, 75-90%, 80-90%, or 85-90% identity to wild-type mRNA sequence.

In some embodiments, at least one mRNA polynucleotide comprises a sequence identified by any one of SEQ ID NO: 491-503 or 566-569 and has less than 80% identity to wild-type mRNA sequence. In some embodiments, at least one mRNA polynucleotide is encoded by a nucleic acid comprising a sequence identified by any one SEQ ID NO: 491-503 or 566-569 and has less than 75%, 85% or 95% identity to a wild-type mRNA sequence. In some embodiments, at least one mRNA polynucleotide is encoded by nucleic acid comprising a sequence identified by any one of SEQ ID NO: 491-503 or 566-569 and has less than 50-80%, 60-80%, 40-80%, 30-80%, 70-80%, 75-80% or 78-80% identity to wild-type mRNA sequence. In some embodiments, at least one mRNA polynucleotide is encoded by a nucleic acid comprising a sequence identified by any one of SEQ ID NO: 491-503 or 566-569 and has less than 40-85%, 50-85%, 60-85%, 30-85%, 70-85%, 75-85% or 80-85% identity to wild-type mRNA sequence. In some embodiments, at least one mRNA polynucleotide is encoded by a nucleic acid comprising a sequence identified by any one of SEQ ID NO: 491-503 or 566-569 and has less than 40-90%, 50-90%, 60-90%, 30-90%, 70-90%, 75-90%, 80-90%, or 85-90% identity to wild-type mRNA sequence.

In some embodiments, at least one RNA polynucleotide encodes at least one antigenic polypeptide comprising an amino acid sequence identified by any one of SEQ ID NO: 1-444, 458, 460, 462-479, or 543-565 (see also Tables 7-13 and 26) and having at least 80% (e.g., 85%, 90%, 95%, 98%, 99%) identity to wild-type mRNA sequence, but does not include wild-type mRNA sequence.

In some embodiments, at least one RNA polynucleotide encodes at least one antigenic polypeptide comprising an amino acid sequence identified by any one of SEQ ID NO: 1-444, 458, 460, 462-479, or 543-565 (see also Tables 7-13 and 26) and has less than 95%, 90%, 85%, 80% or 75% identity to wild-type mRNA sequence. In some embodiments, at least one RNA polynucleotide encodes at least one antigenic polypeptide comprising an amino acid sequence identified by any one of SEQ ID NO: 1-444, 458, 460, 462-479, or 543-565 (see also Tables 7-13 and 26) and has 30-80%, 40-80%, 50-80%, 60-80%, 70-80%, 75-80% or 78-80%, 30-85%, 40-85%, 50-805%, 60-85%, 70-85%, 75-85% or 78-85%, 30-90%, 40-90%, 50-90%, 60-90%, 70-90%, 75-90%, 80-90% or 85-90% identity to wild-type mRNA sequence.

In some embodiments, at least one RNA polynucleotide encodes at least one antigenic polypeptide having at least 90%, at least 95%, at least 96%, at least 97%, at least 98%, or at least 99% identity to an amino acid sequence identified by any one of SEQ ID NO: 1-444, 458, 460, 462-479, or 543-565 (see also Tables 7-13 and 26). In some embodiments, at least one RNA polynucleotide encodes at least one antigenic polypeptide having 95%-99% identity to an amino acid sequence identified by any one of 1-444, 458, 460, 462-479, or 543-565 (see also Tables 7-13 and 26).

In some embodiments, at least one RNA polynucleotide encodes at least one antigenic polypeptide having at least 90%, at least 95%, at least 96%, at least 97%, at least 98%, or at least 99% identity to amino acid sequence identified by any one of SEQ ID NO: 1-444, 458, 460, 462-479, or 543-565 (see also Tables 7-13 and 26) and having membrane fusion activity. In some embodiments, at least one RNA polynucleotide encodes at least one antigenic polypeptide having 95%-99% identity to amino acid sequence identified by any one of SEQ ID NO: 1-444, 458, 460, 462-479, or 543-565 (see also Tables 7-13 and 26) and having membrane fusion activity.

In some embodiments, at least one RNA polynucleotide encodes at least one influenza antigenic polypeptide that attaches to cell receptors.

In some embodiments, at least one RNA polynucleotide encodes at least one influenza antigenic polypeptide that causes fusion of viral and cellular membranes.

In some embodiments, at least one RNA polynucleotide encodes at least one influenza antigenic polypeptide that is responsible for binding of the virus to a cell being infected.

Some embodiments of the present disclosure provide a vaccine that includes at least one ribonucleic acid (RNA) (e.g., mRNA) polynucleotide having an open reading frame encoding at least one influenza antigenic polypeptide, at least one 5' terminal cap and at least one chemical modification, formulated within a lipid nanoparticle.

In some embodiments, a 5' terminal cap is 7mG(5')ppp (5')NlmpNp.

In some embodiments, at least one chemical modification is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, the chemical modification is in the 5-position of the uracil. In some embodiments, the chemical modification is a N1-methylpseudouridine. In some embodiments, the chemical modification is a N1-ethylpseudouridine.

In some embodiments, a lipid nanoparticle comprises a cationic lipid, a PEG-modified lipid, a sterol and a non-cationic lipid. In some embodiments, a cationic lipid is an ionizable cationic lipid and the non-cationic lipid is a neutral lipid, and the sterol is a cholesterol. In some embodiments, a cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), di((Z)-non-2-en-1-yl) 9-((4-(dimethylamino)butanoyl)oxy)heptadecanedioate, (12Z, 15Z)—N,N-dimethyl-2-nonylhenicosa-12,15-dien-1-amine, and N,N-dimethyl-1-[(1S,2R)-2-octylcyclopropyl]heptadecan-8-amine.

In some embodiments, the cationic lipid is

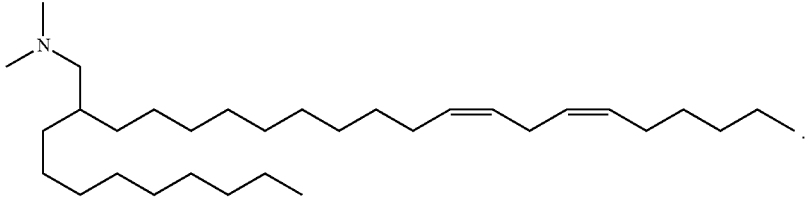 [SMILES: CCCCC/C=C\C/C=C\CCCCCCCCCC(CCCCCCCCC)CN(C)C]

In some embodiments, the cationic lipid is

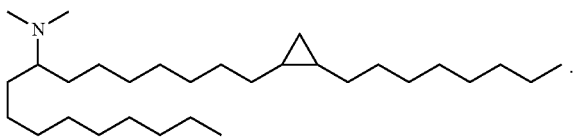 [SMILES: CCCCCCCCCC(CCCCCCCC1CC1CCCCCCCC)N(C)C]

In some embodiments, at least one cationic lipid selected from compounds of Formula (I):

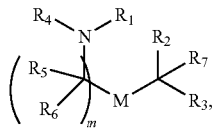

or a salt or isomer thereof, wherein:

$R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a carbocycle, heterocycle, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when $R_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2.

In some embodiments, a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;
$R_7$ is selected from the group consisting of $C_{1-3}$ alkyl, $C_{2-3}$ alkenyl, and H;
$R_8$ is selected from the group consisting of $C_{3-6}$ carbocycle and heterocycle;
$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{2-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

In some embodiments, a subset of compounds of Formula (I) includes those in which
$R_1$ is selected from the group consisting of $C_{5-30}$ alkyl, $C_{5-20}$ alkenyl, —R*YR", —YR", and —R"M'R';
$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;
$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5;
each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;
$R_7$ is selected from the group consisting of $C_{1-3}$ alkyl, $C_{2-3}$ alkenyl, and H;
$R_8$ is selected from the group consisting of $C_{3-6}$ carbocycle and heterocycle;
$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{2-12}$ alkenyl;

each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

In some embodiments, a subset of compounds of Formula (I) includes those in which $R_1$ is selected from the group consisting of $C_{5-30}$ alkyl, $C_{5-20}$ alkenyl, —R*YR", —YR", and —R"M'R';
$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;
$R_4$ is —$(CH_2)_nQ$ or —$(CH_2)_nCHQR$, where Q is —$N(R)_2$, and n is selected from 3, 4, and 5;
each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;
$R_7$ is selected from the group consisting of $C_{1-3}$ alkyl, $C_{2-3}$ alkenyl, and H;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{1-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

In some embodiments, a subset of compounds of Formula (I) includes those in which
$R_1$ is selected from the group consisting of $C_{5-30}$ alkyl, $C_{5-20}$ alkenyl, —R*YR", —YR", and —R"M'R';
$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;
$R_4$ is selected from the group consisting of —$(CH_2)_nQ$, —$(CH_2)_nCHQR$, —CHQR, and —$CQ(R)_2$, where Q is —$N(R)_2$, and n is selected from 1, 2, 3, 4, and 5;
each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;
$R_7$ is selected from the group consisting of $C_{1-3}$ alkyl, $C_{2-3}$ alkenyl, and H;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{1-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

In some embodiments, a subset of compounds of Formula (I) includes those of Formula (IA):

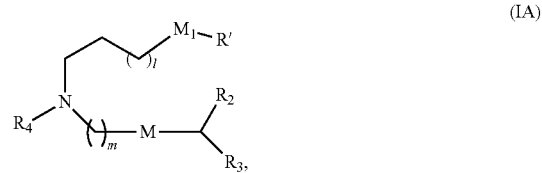

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

Some embodiments of the present disclosure provide a vaccine that includes at least one RNA (e.g., mRNA) polynucleotide having an open reading frame encoding at least one influenza antigenic polypeptide, wherein at least 80% (e.g., 85%, 90%, 95%, 98%, 99%) of the uracil in the open reading frame have a chemical modification, optionally wherein the vaccine is formulated in a lipid nanoparticle (e.g., a lipid nanoparticle comprises a cationic lipid, a PEG-modified lipid, a sterol and a non-cationic lipid).

In some embodiments, 100% of the uracil in the open reading frame have a chemical modification. In some embodiments, a chemical modification is in the 5-position of the uracil. In some embodiments, a chemical modification is a N1-methyl pseudouridine. In some embodiments, 100% of the uracil in the open reading frame have a N1-methyl pseudouridine in the 5-position of the uracil.

In some embodiments, an open reading frame of a RNA (e.g., mRNA) polynucleotide encodes at least two influenza antigenic polypeptides. In some embodiments, the open reading frame encodes at least five or at least ten antigenic polypeptides. In some embodiments, the open reading frame encodes at least 100 antigenic polypeptides. In some embodiments, the open reading frame encodes 2-100 antigenic polypeptides.

In some embodiments, a vaccine comprises at least two RNA (e.g., mRNA) polynucleotides, each having an open reading frame encoding at least one influenza antigenic polypeptide. In some embodiments, the vaccine comprises at least five or at least ten RNA (e.g., mRNA) polynucleotides, each having an open reading frame encoding at least one antigenic polypeptide. In some embodiments, the vaccine comprises at least 100 RNA (e.g., mRNA) polynucleotides, each having an open reading frame encoding at least one antigenic polypeptide. In some embodiments, the vaccine comprises 2-100 RNA (e.g., mRNA) polynucleotides, each having an open reading frame encoding at least one antigenic polypeptide.

In some embodiments, at least one influenza antigenic polypeptide is fused to a signal peptide. In some embodiments, the signal peptide is selected from: a HuIgGk signal peptide (METPAQLLFLLLLWLPDTTG; SEQ ID NO: 480); IgE heavy chain epsilon-1 signal peptide (MDWTWILFLVAAATRVHS; SEQ ID NO: 481); Japanese encephalitis PRM signal sequence (MLG-SNSGQRVVFTILLLLVAPAYS; SEQ ID NO: 482), VSVg protein signal sequence (MKCLLYLAFLFIGVNCA; SEQ ID NO: 483) and Japanese encephalitis JEV signal sequence (MWLVSLAIVTACAGA; SEQ ID NO: 484).

In some embodiments, the signal peptide is fused to the N-terminus of at least one antigenic polypeptide. In some embodiments, a signal peptide is fused to the C-terminus of at least one antigenic polypeptide.

In some embodiments, at least one influenza antigenic polypeptide comprises a mutated N-linked glycosylation site.

Also provided herein is an influenza RNA (e.g., mRNA) vaccine of any one of the foregoing paragraphs formulated in a nanoparticle (e.g., a lipid nanoparticle).

In some embodiments, the nanoparticle has a mean diameter of 50-200 nm. In some embodiments, the nanoparticle is a lipid nanoparticle. In some embodiments, the lipid nanoparticle comprises a cationic lipid, a PEG-modified lipid, a sterol and a non-cationic lipid. In some embodiments, the lipid nanoparticle comprises a molar ratio of about 20-60% cationic lipid, 0.5-15% PEG-modified lipid, 25-55% sterol, and 25% non-cationic lipid. In some embodiments, the cationic lipid is an ionizable cationic lipid and the non-cationic lipid is a neutral lipid, and the sterol is a cholesterol. In some embodiments, the cationic lipid is selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate.

In some embodiments, the nanoparticle has a polydispersity value of less than 0.4 (e.g., less than 0.3, 0.2 or 0.1).

In some embodiments, the nanoparticle has a net neutral charge at a neutral pH value.

In some embodiments, the RNA (e.g., mRNA) vaccine is multivalent.

Some embodiments of the present disclosure provide methods of inducing an antigen specific immune response in a subject, comprising administering to the subject any of the RNA (e.g., mRNA) vaccine as provided herein in an amount effective to produce an antigen-specific immune response. In some embodiments, the RNA (e.g., mRNA) vaccine is an influenza vaccine. In some embodiments, the RNA (e.g., mRNA) vaccine is a combination vaccine comprising a combination of influenza vaccines (a broad spectrum influenza vaccine).

In some embodiments, an antigen-specific immune response comprises a T cell response or a B cell response.

In some embodiments, a method of producing an antigen-specific immune response comprises administering to a subject a single dose (no booster dose) of an influenza RNA (e.g., mRNA) vaccine of the present disclosure.

In some embodiments, a method further comprises administering to the subject a second (booster) dose of an influenza RNA (e.g., mRNA) vaccine. Additional doses of an influenza RNA (e.g., mRNA) vaccine may be administered.

In some embodiments, the subjects exhibit a seroconversion rate of at least 80% (e.g., at least 85%, at least 90%, or at least 95%) following the first dose or the second (booster) dose of the vaccine. Seroconversion is the time period during which a specific antibody develops and becomes detectable in the blood. After seroconversion has occurred, a virus can be detected in blood tests for the antibody. During an infection or immunization, antigens enter the blood, and the immune system begins to produce antibodies in response. Before seroconversion, the antigen itself may or may not be detectable, but antibodies are considered absent. During seroconversion, antibodies are present but not yet detectable. Any time after seroconversion, the antibodies can be detected in the blood, indicating a prior or current infection.

In some embodiments, an influenza RNA (e.g., mRNA) vaccine is administered to a subject by intradermal injection, intramuscular injection, or by intranasal administration. In some embodiments, an influenza RNA (e.g., mRNA) vaccine is administered to a subject by intramuscular injection.

Some embodiments, of the present disclosure provide methods of inducing an antigen specific immune response in a subject, including administering to a subject an influenza RNA (e.g., mRNA) vaccine in an effective amount to produce an antigen specific immune response in a subject. Antigen-specific immune responses in a subject may be determined, in some embodiments, by assaying for antibody titer (for titer of an antibody that binds to an influenza antigenic polypeptide) following administration to the subject of any of the influenza RNA (e.g., mRNA) vaccines of the present disclosure. In some embodiments, the anti-antigenic polypeptide antibody titer produced in the subject is increased by at least 1 log relative to a control. In some embodiments, the anti-antigenic polypeptide antibody titer produced in the subject is increased by 1-3 log relative to a control.

In some embodiments, the anti-antigenic polypeptide antibody titer produced in a subject is increased at least 2 times relative to a control. In some embodiments, the anti-antigenic polypeptide antibody titer produced in the subject is increased at least 5 times relative to a control. In some embodiments, the anti-antigenic polypeptide antibody titer produced in the subject is increased at least 10 times relative to a control. In some embodiments, the anti-antigenic polypeptide antibody titer produced in the subject is increased 2-10 times relative to a control.

In some embodiments, the control is an anti-antigenic polypeptide antibody titer produced in a subject who has not been administered a RNA (e.g., mRNA) vaccine of the present disclosure. In some embodiments, the control is an anti-antigenic polypeptide antibody titer produced in a subject who has been administered a live attenuated or inactivated influenza, or wherein the control is an anti-antigenic polypeptide antibody titer produced in a subject who has been administered a recombinant or purified influenza protein vaccine. In some embodiments, the control is an anti-antigenic polypeptide antibody titer produced in a subject who has been administered an influenza virus-like particle (VLP) vaccine (see, e.g., Cox R G et al., *J Virol.* 2014 June; 88(11): 6368-6379).

A RNA (e.g., mRNA) vaccine of the present disclosure is administered to a subject in an effective amount (an amount effective to induce an immune response). In some embodiments, the effective amount is a dose equivalent to an at least 2-fold, at least 4-fold, at least 10-fold, at least 100-fold, at least 1000-fold reduction in the standard of care dose of a recombinant influenza protein vaccine, wherein the anti-antigenic polypeptide antibody titer produced in the subject is equivalent to an anti-antigenic polypeptide antibody titer produced in a control subject administered the standard of care dose of a recombinant influenza protein vaccine, a purified influenza protein vaccine, a live attenuated influenza vaccine, an inactivated influenza vaccine, or an influenza VLP vaccine. In some embodiments, the effective amount is a dose equivalent to 2-1000-fold reduction in the standard of care dose of a recombinant influenza protein vaccine, wherein the anti-antigenic polypeptide antibody titer produced in the subject is equivalent to an anti-antigenic polypeptide antibody titer produced in a control subject administered the standard of care dose of a recombinant influenza protein vaccine, a purified influenza protein vaccine, a live attenuated influenza vaccine, an inactivated influenza vaccine, or an influenza VLP vaccine.

In some embodiments, the control is an anti-antigenic polypeptide antibody titer produced in a subject who has been administered a virus-like particle (VLP) vaccine comprising structural proteins of influenza.

In some embodiments, the RNA (e.g., mRNA) vaccine is formulated in an effective amount to produce an antigen specific immune response in a subject.

In some embodiments, the effective amount is a total dose of 25 µg to 1000 µg, or 50 µg to 1000 µg. In some embodiments, the effective amount is a total dose of 100 µg. In some embodiments, the effective amount is a dose of 25 µg administered to the subject a total of two times. In some embodiments, the effective amount is a dose of 100 µg administered to the subject a total of two times. In some embodiments, the effective amount is a dose of 400 µg administered to the subject a total of two times. In some embodiments, the effective amount is a dose of 500 µg administered to the subject a total of two times.

In some embodiments, the efficacy (or effectiveness) of a RNA (e.g., mRNA) vaccine is greater than 60%. In some embodiments, the RNA (e.g., mRNA) polynucleotide of the vaccine at least one Influenza antigenic polypeptide.

Vaccine efficacy may be assessed using standard analyses (see, e.g., Weinberg et al., *J Infect Dis.* 2010 Jun. 1; 201(11):1607-10). For example, vaccine efficacy may be measured by double-blind, randomized, clinical controlled trials. Vaccine efficacy may be expressed as a proportionate reduction in disease attack rate (AR) between the unvaccinated (ARU) and vaccinated (ARV) study cohorts and can be calculated from the relative risk (RR) of disease among the vaccinated group with use of the following formulas:

Efficacy=(ARU−ARV)/ARU×100; and

Efficacy=(1−RR)×100.

Likewise, vaccine effectiveness may be assessed using standard analyses (see, e.g., Weinberg et al., *J Infect Dis.* 2010 Jun. 1; 201(11):1607-10). Vaccine effectiveness is an assessment of how a vaccine (which may have already proven to have high vaccine efficacy) reduces disease in a population. This measure can assess the net balance of benefits and adverse effects of a vaccination program, not just the vaccine itself, under natural field conditions rather than in a controlled clinical trial. Vaccine effectiveness is proportional to vaccine efficacy (potency) but is also affected by how well target groups in the population are immunized, as well as by other non-vaccine-related factors that influence the 'real-world' outcomes of hospitalizations, ambulatory visits, or costs. For example, a retrospective case control analysis may be used, in which the rates of vaccination among a set of infected cases and appropriate controls are compared. Vaccine effectiveness may be expressed as a rate difference, with use of the odds ratio (OR) for developing infection despite vaccination:

Effectiveness=(1−OR)×100.

In some embodiments, the efficacy (or effectiveness) of a RNA (e.g., mRNA) vaccine is at least 65%, at least 70%, at least 75%, at least 80%, at least 85%, or at least 90%.

In some embodiments, the vaccine immunizes the subject against Influenza for up to 2 years. In some embodiments, the vaccine immunizes the subject against Influenza for more than 2 years, more than 3 years, more than 4 years, or for 5-10 years.

In some embodiments, the subject is about 5 years old or younger. For example, the subject may be between the ages of about 1 year and about 5 years (e.g., about 1, 2, 3, 5 or 5 years), or between the ages of about 6 months and about 1 year (e.g., about 6, 7, 8, 9, 10, 11 or 12 months). In some embodiments, the subject is about 12 months or younger (e.g., 12, 11, 10, 9, 8, 7, 6, 5, 4, 3, 2 months or 1 month). In some embodiments, the subject is about 6 months or younger.

In some embodiments, the subject was born full term (e.g., about 37-42 weeks). In some embodiments, the subject was born prematurely, for example, at about 36 weeks of gestation or earlier (e.g., about 36, 35, 34, 33, 32, 31, 30, 29, 28, 27, 26 or 25 weeks). For example, the subject may have been born at about 32 weeks of gestation or earlier. In some embodiments, the subject was born prematurely between about 32 weeks and about 36 weeks of gestation. In such subjects, a RNA (e.g., mRNA) vaccine may be administered later in life, for example, at the age of about 6 months to about 5 years, or older.

In some embodiments, the subject is a young adult between the ages of about 20 years and about 50 years (e.g., about 20, 25, 30, 35, 40, 45 or 50 years old).

In some embodiments, the subject is an elderly subject about 60 years old, about 70 years old, or older (e.g., about 60, 65, 70, 75, 80, 85 or 90 years old).

In some embodiments, the subject has been exposed to influenza (e.g., *C. trachomatis*); the subject is infected with influenza (e.g., *C. trachomatis*); or subject is at risk of infection by influenza (e.g., *C. trachomatis*).

In some embodiments, the subject is immunocompromised (has an impaired immune system, e.g., has an immune disorder or autoimmune disorder).

In some embodiments the nucleic acid vaccines described herein are chemically modified. In other embodiments the nucleic acid vaccines are unmodified.

Yet other aspects provide compositions for and methods of vaccinating a subject comprising administering to the subject a nucleic acid vaccine comprising one or more RNA polynucleotides having an open reading frame encoding a first virus antigenic polypeptide, wherein the RNA polynucleotide does not include a stabilization element, and wherein an adjuvant is not coformulated or co-administered with the vaccine.

In other aspects the invention is a composition for or method of vaccinating a subject comprising administering to the subject a nucleic acid vaccine comprising one or more RNA polynucleotides having an open reading frame encoding a first antigenic polypeptide wherein a dosage of between 10 µg/kg and 400 µg/kg of the nucleic acid vaccine is administered to the subject. In some embodiments the dosage of the RNA polynucleotide is 1-5 µg, 5-10 µg, 10-15 µg, 15-20 µg, 10-25 µg, 20-25 µg, 20-50 µg, 30-50 µg, 40-50 µg, 40-60 µg, 60-80 µg, 60-100 µg, 50-100 µg, 80-120 µg, 40-120 µg, 40-150 µg, 50-150 µg, 50-200 µg, 80-200 µg, 100-200 µg, 120-250 µg, 150-250 µg, 180-280 µg, 200-300 µg, 50-300 µg, 80-300 µg, 100-300 µg, 40-300 µg, 50-350 µg, 100-350 µg, 200-350 µg, 300-350 µg, 320-400 µg, 40-380 µg, 40-100 µg, 100-400 µg, 200-400 µg, or 300-400

µg per dose. In some embodiments, the nucleic acid vaccine is administered to the subject by intradermal or intramuscular injection. In some embodiments, the nucleic acid vaccine is administered to the subject on day zero. In some embodiments, a second dose of the nucleic acid vaccine is administered to the subject on day twenty one.

In some embodiments, a dosage of 25 micrograms of the RNA polynucleotide is included in the nucleic acid vaccine administered to the subject. In some embodiments, a dosage of 100 micrograms of the RNA polynucleotide is included in the nucleic acid vaccine administered to the subject. In some embodiments, a dosage of 50 micrograms of the RNA polynucleotide is included in the nucleic acid vaccine administered to the subject. In some embodiments, a dosage of 75 micrograms of the RNA polynucleotide is included in the nucleic acid vaccine administered to the subject. In some embodiments, a dosage of 150 micrograms of the RNA polynucleotide is included in the nucleic acid vaccine administered to the subject. In some embodiments, a dosage of 400 micrograms of the RNA polynucleotide is included in the nucleic acid vaccine administered to the subject. In some embodiments, a dosage of 200 micrograms of the RNA polynucleotide is included in the nucleic acid vaccine administered to the subject. In some embodiments, the RNA polynucleotide accumulates at a 100 fold higher level in the local lymph node in comparison with the distal lymph node. In other embodiments the nucleic acid vaccine is chemically modified and in other embodiments the nucleic acid vaccine is not chemically modified.

Aspects of the invention provide a nucleic acid vaccine comprising one or more RNA polynucleotides having an open reading frame encoding a first antigenic polypeptide, wherein the RNA polynucleotide does not include a stabilization element, and a pharmaceutically acceptable carrier or excipient, wherein an adjuvant is not included in the vaccine. In some embodiments, the stabilization element is a histone stem-loop. In some embodiments, the stabilization element is a nucleic acid sequence having increased GC content relative to wild type sequence.

Aspects of the invention provide nucleic acid vaccines comprising one or more RNA polynucleotides having an open reading frame encoding a first antigenic polypeptide, wherein the RNA polynucleotide is present in the formulation for in vivo administration to a host, which confers an antibody titer superior to the criterion for seroprotection for the first antigen for an acceptable percentage of human subjects. In some embodiments, the antibody titer produced by the mRNA vaccines of the invention is a neutralizing antibody titer. In some embodiments the neutralizing antibody titer is greater than a protein vaccine. In other embodiments the neutralizing antibody titer produced by the mRNA vaccines of the invention is greater than an adjuvanted protein vaccine. In yet other embodiments the neutralizing antibody titer produced by the mRNA vaccines of the invention is 1,000-10,000, 1,200-10,000, 1,400-10,000, 1,500-10,000, 1,000-5,000, 1,000-4,000, 1,800-10,000, 2000-10,000, 2,000-5,000, 2,000-3,000, 2,000-4,000, 3,000-5,000, 3,000-4,000, or 2,000-2,500. A neutralization titer is typically expressed as the highest serum dilution required to achieve a 50% reduction in the number of plaques.

Also provided are nucleic acid vaccines comprising one or more RNA polynucleotides having an open reading frame encoding a first antigenic polypeptide, wherein the RNA polynucleotide is present in a formulation for in vivo administration to a host for eliciting a longer lasting high antibody titer than an antibody titer elicited by an mRNA vaccine having a stabilizing element or formulated with an adjuvant and encoding the first antigenic polypeptide. In some embodiments, the RNA polynucleotide is formulated to produce a neutralizing antibodies within one week of a single administration. In some embodiments, the adjuvant is selected from a cationic peptide and an immunostimulatory nucleic acid. In some embodiments, the cationic peptide is protamine.

Aspects provide nucleic acid vaccines comprising one or more RNA polynucleotides having an open reading frame comprising at least one chemical modification or optionally no modified nucleotides, the open reading frame encoding a first antigenic polypeptide, wherein the RNA polynucleotide is present in the formulation for in vivo administration to a host such that the level of antigen expression in the host significantly exceeds a level of antigen expression produced by an mRNA vaccine having a stabilizing element or formulated with an adjuvant and encoding the first antigenic polypeptide.

Other aspects provide nucleic acid vaccines comprising one or more RNA polynucleotides having an open reading frame comprising at least one chemical modification or optionally no modified nucleotides, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Aspects of the invention also provide a unit of use vaccine, comprising between 10 ug and 400 µg of one or more RNA polynucleotides having an open reading frame comprising at least one chemical modification or optionally no modified nucleotides, the open reading frame encoding a first antigenic polypeptide, and a pharmaceutically acceptable carrier or excipient, formulated for delivery to a human subject. In some embodiments, the vaccine further comprises a cationic lipid nanoparticle.

Aspects of the invention provide methods of creating, maintaining or restoring antigenic memory to a virus strain in an individual or population of individuals comprising administering to said individual or population an antigenic memory booster nucleic acid vaccine comprising (a) at least one RNA polynucleotide, said polynucleotide comprising at least one chemical modification or optionally no modified nucleotides and two or more codon-optimized open reading frames, said open reading frames encoding a set of reference antigenic polypeptides, and (b) optionally a pharmaceutically acceptable carrier or excipient. In some embodiments, the vaccine is administered to the individual via a route selected from the group consisting of intramuscular administration, intradermal administration and subcutaneous administration. In some embodiments, the administering step comprises contacting a muscle tissue of the subject with a device suitable for injection of the composition. In some embodiments, the administering step comprises contacting a muscle tissue of the subject with a device suitable for injection of the composition in combination with electroporation.

Aspects of the invention provide methods of vaccinating a subject comprising administering to the subject a single dosage of between 25 µg/kg and 400 µg/kg of a nucleic acid vaccine comprising one or more RNA polynucleotides having an open reading frame encoding a first antigenic polypeptide in an effective amount to vaccinate the subject.

Other aspects provide nucleic acid vaccines comprising one or more RNA polynucleotides having an open reading frame comprising at least one chemical modification, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Other aspects provide nucleic acid vaccines comprising an LNP formulated RNA polynucleotide having an open reading frame comprising no nucleotide modifications (unmodified), the open reading frame encoding a first antigenic polypeptide, wherein the vaccine has at least 10 fold less RNA polynucleotide than is required for an unmodified mRNA vaccine not formulated in a LNP to produce an equivalent antibody titer. In some embodiments, the RNA polynucleotide is present in a dosage of 25-100 micrograms.

The data presented in the Examples demonstrate significant enhanced immune responses using the formulations of the invention. Both chemically modified and unmodified RNA vaccines are useful according to the invention. Surprisingly, in contrast to prior art reports that it was preferable to use chemically unmodified mRNA formulated in a carrier for the production of vaccines, it is described herein that chemically modified mRNA-LNP vaccines required a much lower effective mRNA dose than unmodified mRNA, i.e., tenfold less than unmodified mRNA when formulated in carriers other than LNP. Both the chemically modified and unmodified RNA vaccines of the invention produce better immune responses than mRNA vaccines formulated in a different lipid carrier.

In other aspects the invention encompasses a method of treating an elderly subject age 60 years or older comprising administering to the subject a nucleic acid vaccine comprising one or more RNA polynucleotides having an open reading frame encoding an virus antigenic polypeptide in an effective amount to vaccinate the subject.

In other aspects the invention encompasses a method of treating a young subject age 17 years or younger comprising administering to the subject a nucleic acid vaccine comprising one or more RNA polynucleotides having an open reading frame encoding an virus antigenic polypeptide in an effective amount to vaccinate the subject.

In other aspects the invention encompasses a method of treating an adult subject comprising administering to the subject a nucleic acid vaccine comprising one or more RNA polynucleotides having an open reading frame encoding an virus antigenic polypeptide in an effective amount to vaccinate the subject.

In some aspects the invention is a method of vaccinating a subject with a combination vaccine including at least two nucleic acid sequences encoding antigens wherein the dosage for the vaccine is a combined therapeutic dosage wherein the dosage of each individual nucleic acid encoding an antigen is a sub therapeutic dosage. In some embodiments, the combined dosage is 25 micrograms of the RNA polynucleotide in the nucleic acid vaccine administered to the subject. In some embodiments, the combined dosage is 100 micrograms of the RNA polynucleotide in the nucleic acid vaccine administered to the subject. In some embodiments the combined dosage is 50 micrograms of the RNA polynucleotide in the nucleic acid vaccine administered to the subject. In some embodiments, the combined dosage is 75 micrograms of the RNA polynucleotide in the nucleic acid vaccine administered to the subject. In some embodiments, the combined dosage is 150 micrograms of the RNA polynucleotide in the nucleic acid vaccine administered to the subject. In some embodiments, the combined dosage is 400 micrograms of the RNA polynucleotide in the nucleic acid vaccine administered to the subject. In some embodiments, the sub therapeutic dosage of each individual nucleic acid encoding an antigen is 1, 2, 3, 4, 5, 6, 7, 8, 9, 10, 11, 12, 13, 14, 15, 16, 17, 18, 19, or 20 micrograms. In other embodiments the nucleic acid vaccine is chemically modified and in other embodiments the nucleic acid vaccine is not nucleotide modified.

In some embodiments, the RNA polynucleotide is one of SEQ ID NO: 447-457, 459, 461, 491-503, 524-542, or 566-569 and includes at least one chemical modification. In other embodiments, the RNA polynucleotide is one of SEQ ID NO: 447-457, 459, 461, 491-503, 524-542, or 566-569 and does not include any nucleotide modifications, or is unmodified. In yet other embodiments the at least one RNA polynucleotide encodes an antigenic protein of any of SEQ ID NO: 1-444, 458, 460, 462-479, 543-565, or 566-569 and includes at least one chemical modification. In other embodiments the RNA polynucleotide encodes an antigenic protein of any of SEQ ID NO: 1-444, 458, 460, 462-479, 543-565, or 566-569 and does not include any nucleotide modifications, or is unmodified.

In preferred aspects, vaccines of the invention (e.g., LNP-encapsulated mRNA vaccines) produce prophylactically- and/or therapeutically-efficacious levels, concentrations and/or titers of antigen-specific antibodies in the blood or serum of a vaccinated subject. As defined herein, the term antibody titer refers to the amount of antigen-specific antibody produces in s subject, e.g., a human subject. In exemplary embodiments, antibody titer is expressed as the inverse of the greatest dilution (in a serial dilution) that still gives a positive result. In exemplary embodiments, antibody titer is determined or measured by enzyme-linked immunosorbent assay (ELISA). In exemplary embodiments, antibody titer is determined or measured by neutralization assay, e.g., by microneutralization assay. In certain aspects, antibody titer measurement is expressed as a ratio, such as 1:40, 1:100, etc.

In exemplary embodiments of the invention, an efficacious vaccine produces an antibody titer of greater than 1:40, greater that 1:100, greater than 1:400, greater than 1:1000, greater than 1:2000, greater than 1:3000, greater than 1:4000, greater than 1:500, greater than 1:6000, greater than 1:7500, greater than 1:10000. In exemplary embodiments, the antibody titer is produced or reached by 10 days following vaccination, by 20 days following vaccination, by 30 days following vaccination, by 40 days following vaccination, or by 50 or more days following vaccination. In exemplary embodiments, the titer is produced or reached following a single dose of vaccine administered to the subject. In other embodiments, the titer is produced or reached following multiple doses, e.g., following a first and a second dose (e.g., a booster dose).

In exemplary aspects of the invention, antigen-specific antibodies are measured in units of µg/ml or are measured in units of IU/L (International Units per liter) or mIU/ml (milli International Units per ml). In exemplary embodiments of the invention, an efficacious vaccine produces >0.5 µg/ml, >0.1 µg/ml, >0.2 µg/ml, >0.35 µg/ml, >0.5 µg/ml, >1 µg/ml, >2 µg/ml, >5 µg/ml or >10 µg/ml. In exemplary embodiments of the invention, an efficacious vaccine produces >10 mIU/ml, >20 mIU/ml, >50 mIU/ml, >100 mIU/ml, >200 mIU/ml, >500 mIU/ml or >1000 mIU/ml. In exemplary embodiments, the antibody level or concentration is produced or reached by 10 days following vaccination, by 20 days following vaccination, by 30 days following vaccination, by 40 days following vaccination, or by 50 or more days following vaccination. In exemplary embodiments, the level or concentration is produced or reached following a single dose of vaccine administered to the subject. In other embodiments, the level or concentration is produced or reached following multiple doses, e.g., following a first and a second dose (e.g., a booster dose.) In exemplary embodiments, antibody level or concentration is determined or measured by enzyme-linked immunosorbent assay (ELISA). In exemplary embodiments, antibody level or concentration is determined or measured by neutralization assay, e.g., by microneutralization assay.

The details of various embodiments of the disclosure are set forth in the description below. Other features, objects, and advantages of the disclosure will be apparent from the description and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

In FIG. 4A, the vaccines tested are shown on the x-axis and the binding to HA from each of the different strains of influenza is plotted as an endpoint titer. In FIG. 4B, the vaccines tested are shown on the x-axis, and the endpoint titer to NP protein is plotted.

FIG. 14 shows the results of neutralization assays performed on a panel of pseudoviruses to assess the breadth of the serum-neutralizing activity elicited by the consensus HA antigens.

FIG. 15B shows murine survival (left) and weight loss (right) following challenge with a lethal dose of mouse-adapted B/Ann Arbor/1954. The percentage of group survival and weight loss as compared to baseline was calculated and plotted over time in days.

FIG. 16A shows titers to HA stem, over time, for four rhesus macaques previously vaccinated with FLUZONE® and boosted a single time with NIHGen6HASS-foldon mRNA vaccine. FIG. 16B depicts titers to HA stem, over time, from four rhesus macaques vaccinated at days 0, 28 and 56 with the same NIHGen6HASS-foldon RNA vaccine. FIG. 16C illustrates antibody titers to NP, over time, for four rhesus macaques vaccinated at days 0, 28 and 56 with the NP mRNA vaccine and shows that the vaccine elicited a robust antibody response to NP.

FIG. 17A shows the results of rhesus macaques previously vaccinated with FLUZONE® and boosted a single time with NIHGen6HASS-foldon mRNA vaccine, and FIG. 17B shows the results of naive rhesus macaques vaccinated at days 0, 28 and 56 with the same NIHGen6HASS-foldon RNA vaccine.

DETAILED DESCRIPTION

Figure 1:
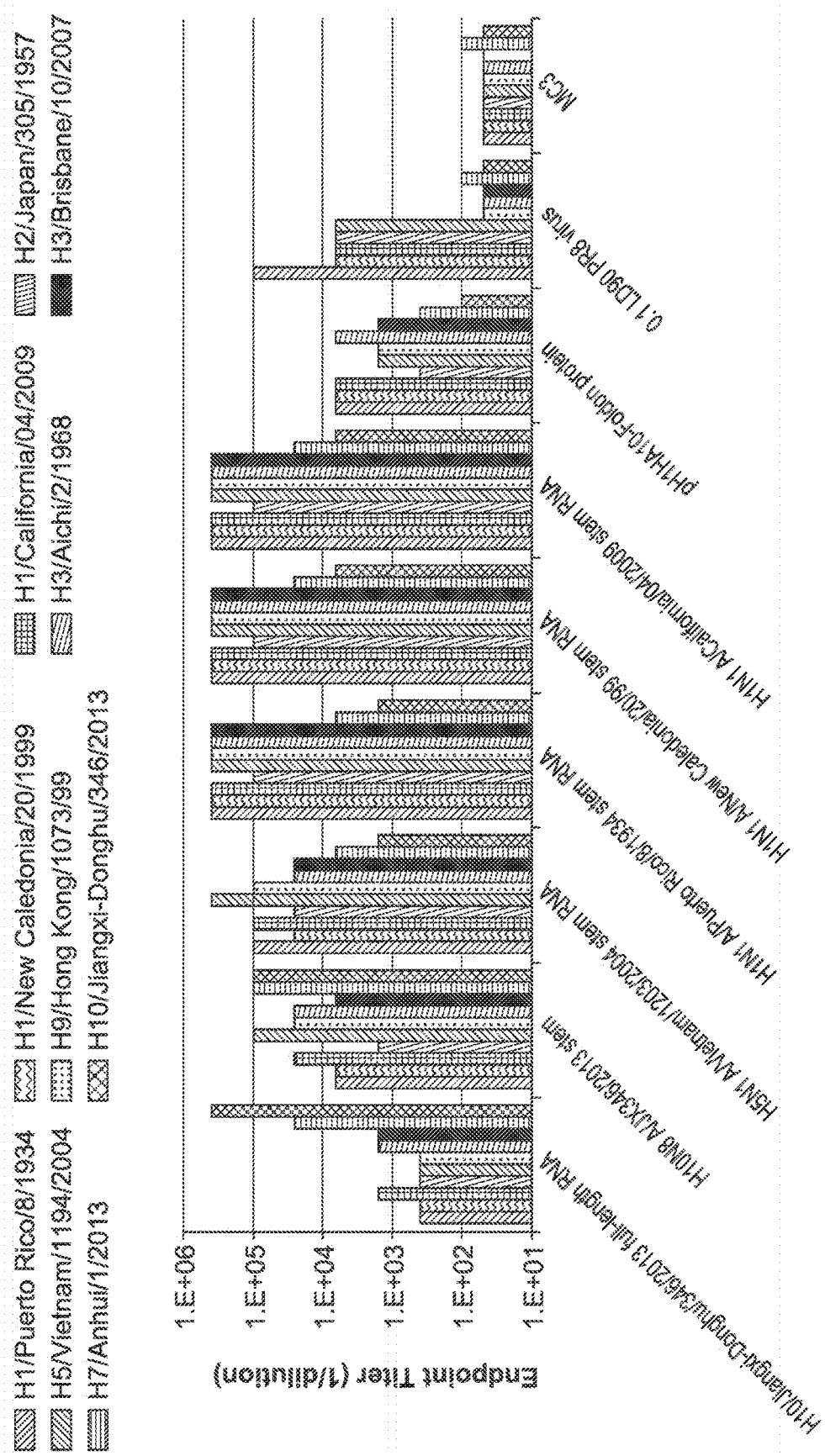
FIG. 1 shows data obtained from an ELISA, demonstrating that vaccination with RNA encoding HA stem protein sequences from different strains induces serum antibodies that bind to diverse panel of recombinant HA (rHA) proteins.
Figure 2:
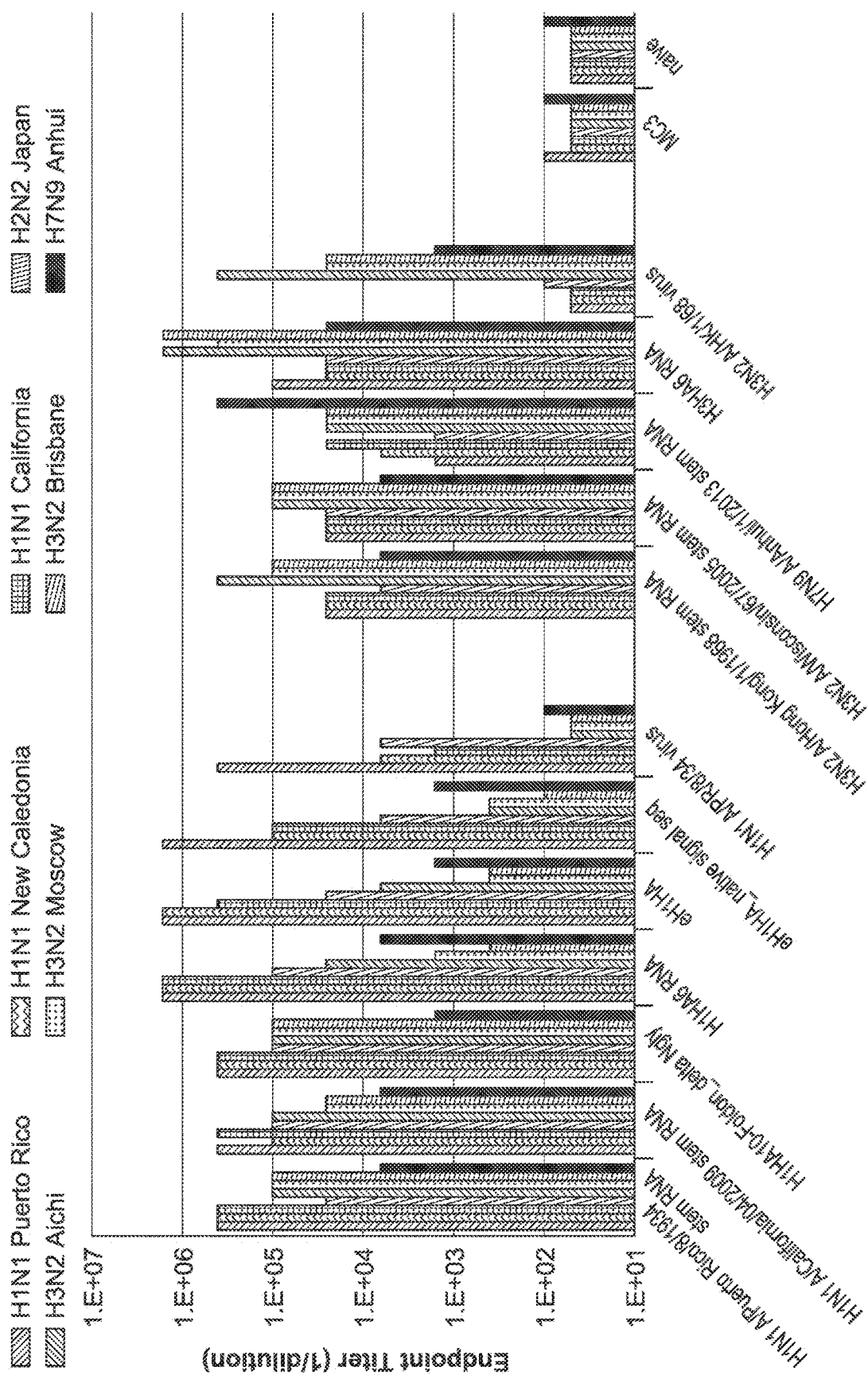
FIG. 2 shows data demonstrating that serum antibody titers obtained from mice vaccinated with a second set of mRNA vaccine antigens induces serum antibodies that bind to a diverse panel of recombinant HA (rHA) proteins.
Figure 3:
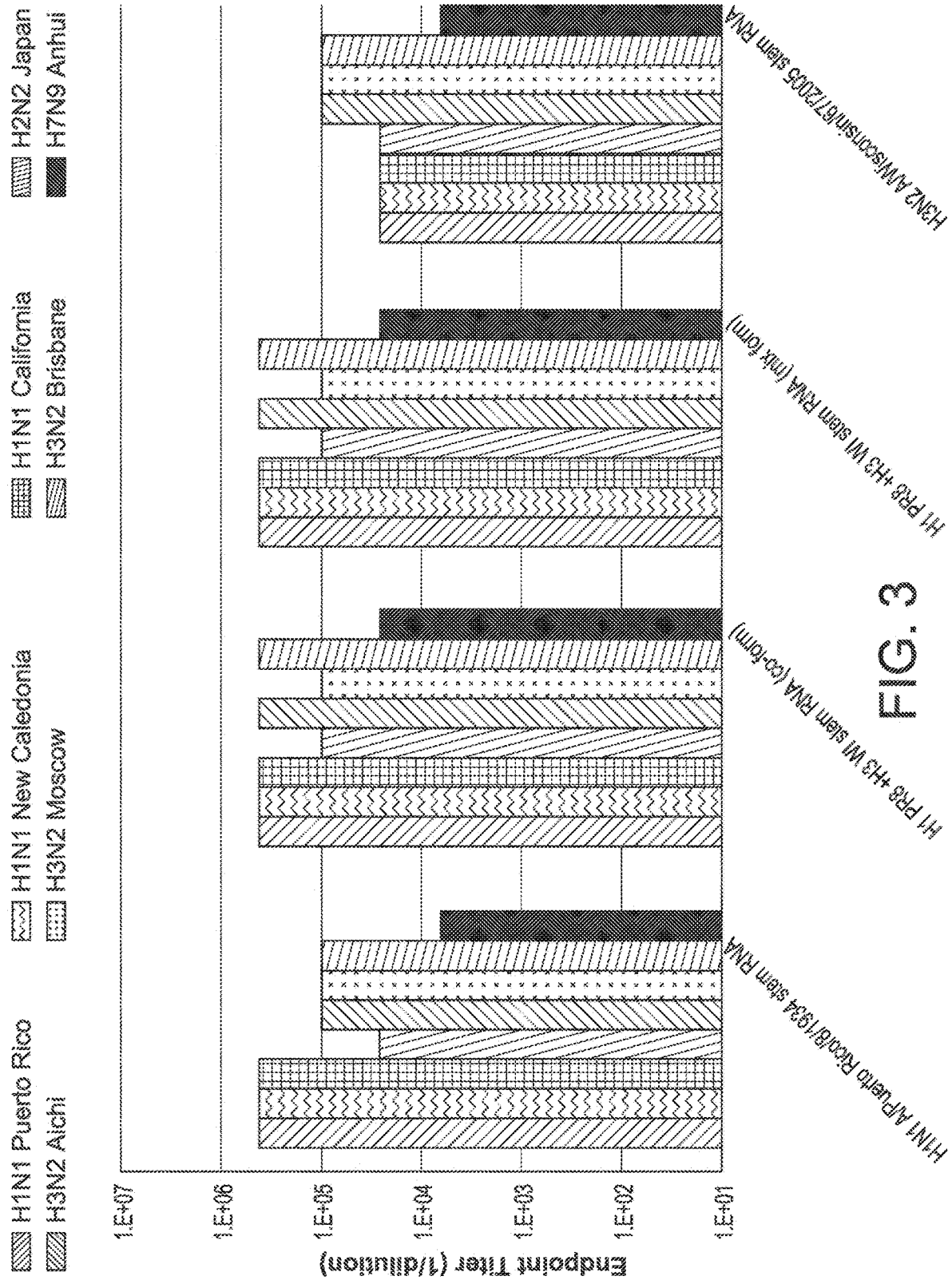
FIG. 3 shows combining mRNAs encoding HA stem protein from an H1 strain with mRNA encoding HA stem protein from an H3 strain did not result in interference in the immune response to either HA.

Embodiments of the present disclosure provide RNA (e.g., mRNA) vaccines that include polynucleotide encoding an influenza virus antigen. Influenza virus RNA vaccines, as provided herein may be used to induce a balanced immune response, comprising both cellular and humoral immunity, without many of the risks associated with DNA vaccination.

In some embodiments, the virus is a strain of Influenza A or Influenza B or combinations thereof. In some embodiments, the strain of Influenza A or Influenza B is associated with birds, pigs, horses, dogs, humans or non-human primates. In some embodiments, the antigenic polypeptide encodes a hemagglutinin protein. In some embodiments, the hemagglutinin protein is H1, H2, H3, H4, H5, H6, H7, H8, H9, H10, H11, H12, H13, H14, H15, H16, H17, H18. In some embodiments, the hemagglutinin protein does not comprise a head domain. In some embodiments, the hemagglutinin protein comprises a portion of the head domain. In some embodiments, the hemagglutinin protein does not comprise a cytoplasmic domain. In some embodiments, the hemagglutinin protein comprises a portion of the cytoplasmic domain. In some embodiments, the truncated hemagglutinin protein comprises a portion of the transmembrane domain. In some embodiments, the amino acid sequence of the hemagglutinin protein comprises at least 90%, 91%, 92%, 93%, 94%, 95%, 96%, 97% 98%, or 99% identify with any of the amino acid sequences having an amino acid sequence identified by any one of SEQ ID NO: 1-444, 458, 460, 462-479, or 543-561 (see also Tables 7-13 and 26). In some embodiments, the virus is selected from the group consisting of H1N1, H3N2, H7N9, and H10N8. In some embodiments, the antigenic polypeptide is selected from those proteins having an amino acid sequences identified by any one of SEQ ID NO: 1-444, 458, 460, 462-479, or 543-561 (see also Tables 7-13 and 26).

Some embodiments provide influenza vaccines comprising one or more RNA polynucleotides having an open reading frame encoding a hemagglutinin protein and a pharmaceutically acceptable carrier or excipient, formulated within a cationic lipid nanoparticle. In some embodiments, the hemagglutinin protein is selected from H1, H7 and H10. In some embodiments, the RNA polynucleotide further encodes neuraminidase protein. In some embodiments, the hemagglutinin protein is derived from a strain of Influenza A virus or Influenza B virus or combinations thereof. In some embodiments, the Influenza virus is selected from H1N1, H3N2, H7N9, and H10N8.

Some embodiments provide methods of preventing or treating influenza viral infection comprising administering to a subject any of the vaccines described herein. In some embodiments, the antigen specific immune response comprises a T cell response. In some embodiments, the antigen specific immune response comprises a B cell response. In some embodiments, the antigen specific immune response comprises both a T cell response and a B cell response. In some embodiments, the method of producing an antigen specific immune response involves a single administration of the vaccine. In some embodiments, the vaccine is administered to the subject by intradermal, intramuscular injection, subcutaneous injection, intranasal inoculation, or oral administration.

In some embodiments, the RNA (e.g., mRNA) polynucleotides or portions thereof may encode one or more polypeptides of an influenza strain as an antigen. Such antigens include, but are not limited to, those antigens encoded by the polynucleotides or portions thereof of the polynucleotides listed in the Tables presented herein. In the Tables, the GenBank Accession Number or GI Accession Number represents either the complete or partial CDS of the encoded antigen. The RNA (e.g., mRNA) polynucleotides may comprise a region of any of the sequences listed in the Tables or entire coding region of the mRNA listed. They may comprise hybrid or chimeric regions, or mimics or variants.

In the following embodiments, when referring to at least one RNA (e.g., mRNA) polynucleotide having an open reading frame encoding for a specific influenza virus protein, the polynucleotides may comprise a coding region of the specific influenza virus protein sequence or the entire coding region of the mRNA for that specific influenza virus protein sequence.

In some embodiments, a vaccine comprises at least one RNA (e.g., mRNA) polynucleotide having an open reading frame encoding a HA protein (e.g., at least one HA1, HA2, or a combination of both, of H1-H18).

In some embodiments, a vaccine comprises at least one RNA (e.g., mRNA) polynucleotide having an open reading frame encoding a HA protein (e.g., at least one HA1, HA2, or a combination of both, of H1-H18) and at least one protein selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of H1-H18) and at least two proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of H1-H18) and at least three proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of H1-H18) and at least four proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of H1-H18) and at least five proteins selected from a NP protein, a NA protein, a M1 protein, a M2 protein, a NS1 protein and a NS2 protein obtained from influenza virus.

In some embodiments, a vaccine comprises at least one RNA (e.g., mRNA) polynucleotide having an open reading frame encoding a HA protein (e.g., at least one of H1-H18), a NP protein, a NA protein, a M1 protein, a M2 protein, a NS1 protein, and a NS2 protein obtained from influenza virus.

In some embodiments, a vaccine comprises at least one RNA (e.g., mRNA) polynucleotide having an open reading frame encoding a HA protein and a NA protein obtained from influenza virus.

In some embodiments, a vaccine comprises at least one RNA (e.g., mRNA) polynucleotide having an open reading frame encoding a HA protein and a M1 protein obtained from influenza virus.

In some embodiments, a vaccine comprises at least one RNA (e.g., mRNA) polynucleotide having an open reading frame encoding a HA protein and a M2 protein obtained from influenza virus.

In some embodiments, a vaccine comprises at least one RNA (e.g., mRNA) polynucleotide having an open reading frame encoding a HA protein and a NS1 protein obtained from influenza virus.

In some embodiments, a vaccine comprises at least one RNA (e.g., mRNA) polynucleotide having an open reading frame encoding a HA protein and a NS2 protein obtained from influenza virus.

In some embodiments, a vaccine comprises at least one RNA (e.g., mRNA) polynucleotide having an open reading frame encoding a HA protein, a NP protein and a NA protein obtained from influenza virus.

In some embodiments, a vaccine comprises at least one RNA (e.g., mRNA) polynucleotide having an open reading frame encoding a HA protein, a NP protein, and a M1 protein obtained from influenza virus.

In some embodiments, a vaccine comprises at least one RNA (e.g., mRNA) polynucleotide having an open reading frame encoding a HA protein, a NP protein, and a M2 protein obtained from influenza virus.

In some embodiments, a vaccine comprises at least one RNA (e.g., mRNA) polynucleotide having an open reading frame encoding a HA protein, a NP protein, and a NS1 protein obtained from influenza virus.

In some embodiments, a vaccine comprises at least one RNA (e.g., mRNA) polynucleotide having an open reading frame encoding a HA protein, a NP protein, and a NS2 protein, obtained from influenza virus.

In some embodiments, a vaccine comprises at least one RNA (e.g., mRNA) polynucleotide having an open reading frame encoding a HA protein, a NA protein, and a M1 protein, obtained from influenza virus.

In some embodiments, a vaccine comprises at least one RNA (e.g., mRNA) polynucleotide having an open reading frame encoding a HA protein, a NA protein, and a M2 protein, obtained from influenza virus.

In some embodiments, a vaccine comprises at least one RNA (e.g., mRNA) polynucleotide having an open reading frame encoding a HA protein, a NA protein, and a NS1 protein, obtained from influenza virus.

In some embodiments, a vaccine comprises at least one RNA (e.g., mRNA) polynucleotide having an open reading frame encoding a HA protein, a NA protein, and a NS2 protein, obtained from influenza virus.

In some embodiments, a vaccine comprises at least one RNA (e.g., mRNA) polynucleotide having an open reading frame encoding a HA protein, a M1 protein, and a M2 protein, obtained from influenza virus.

In some embodiments, a vaccine comprises at least one RNA (e.g., mRNA) polynucleotide having an open reading frame encoding a HA protein, a M1 protein, and a NS1 protein, obtained from influenza virus.

In some embodiments, a vaccine comprises at least one RNA (e.g., mRNA) polynucleotide having an open reading frame encoding a HA protein, a M1 protein, and a NS2 protein, obtained from influenza virus.

In some embodiments, a vaccine comprises at least one RNA (e.g., mRNA) polynucleotide having an open reading frame encoding a HA protein, a M2 protein, and a NS1 protein, obtained from influenza virus.

In some embodiments, a vaccine comprises at least one RNA (e.g., mRNA) polynucleotide having an open reading frame encoding a HA protein, a M2 protein, and a NS2 protein, obtained from influenza virus.

In some embodiments, a vaccine comprises at least one RNA (e.g., mRNA) polynucleotide having an open reading frame encoding a HA protein, a NS1 protein, and a NS2 protein, obtained from influenza virus.

In some embodiments, a vaccine comprises at least one RNA (e.g., mRNA) polynucleotide having an open reading frame encoding a HA1 protein, and a NA protein, obtained from influenza virus.

In some embodiments, a vaccine comprises at least one RNA (e.g., mRNA) polynucleotide having an open reading frame encoding a HA1 protein and a M1 protein, obtained from influenza virus.

In some embodiments, a vaccine comprises at least one RNA (e.g., mRNA) polynucleotide having an open reading frame encoding a HA1 protein and a M2 protein, obtained from influenza virus.

In some embodiments, a vaccine comprises at least one RNA (e.g., mRNA) polynucleotide having an open reading frame encoding a HA1 protein and a NS1 protein, obtained from influenza virus.

In some embodiments, a vaccine comprises at least one RNA (e.g., mRNA) polynucleotide having an open reading frame encoding a HA1 protein and a NS2 protein, obtained from influenza virus.

In some embodiments, a vaccine comprises at least one RNA (e.g., mRNA) polynucleotide having an open reading frame encoding a HA1 protein, a NP protein, and a NA protein, obtained from influenza virus.

In some embodiments, a vaccine comprises at least one RNA (e.g., mRNA) polynucleotide having an open reading frame encoding a HA1 protein, a NP protein, and a M1 protein, obtained from influenza virus.

In some embodiments, a vaccine comprises at least one RNA (e.g., mRNA) polynucleotide having an open reading frame encoding a HA1 protein, a NP protein, and a M2 protein, obtained from influenza virus.

In some embodiments, a vaccine comprises at least one RNA (e.g., mRNA) polynucleotide having an open reading frame encoding a HA1 protein, a NP protein, and a NS1 protein, obtained from influenza virus.

In some embodiments, a vaccine comprises at least one RNA (e.g., mRNA) polynucleotide having an open reading frame encoding a HA1 protein, a NP protein, and a NS2 protein, obtained from influenza virus.

In some embodiments, a vaccine comprises at least one RNA (e.g., mRNA) polynucleotide having an open reading frame encoding a HA1 protein, a NA protein, and a M1 protein, obtained from influenza virus.

In some embodiments, a vaccine comprises at least one RNA (e.g., mRNA) polynucleotide having an open reading frame encoding a HA1 protein, a NA protein, and a M2 protein, obtained from influenza virus.

In some embodiments, a vaccine comprises at least one RNA (e.g., mRNA) polynucleotide having an open reading frame encoding a HA1 protein, a NA protein and a NS1 protein, obtained from influenza virus.

In some embodiments, a vaccine comprises at least one RNA (e.g., mRNA) polynucleotide having an open reading frame encoding a HA1 protein, a NA protein, and a NS2 protein, obtained from influenza virus.

In some embodiments, a vaccine comprises at least one RNA (e.g., mRNA) polynucleotide having an open reading frame encoding a HA1 protein, a M1 protein, and a M2 protein, obtained from influenza virus.

In some embodiments, a vaccine comprises at least one RNA (e.g., mRNA) polynucleotide having an open reading frame encoding a HA1 protein, a M1 protein, and a NS1 protein, obtained from influenza virus.

In some embodiments, a vaccine comprises at least one RNA (e.g., mRNA) polynucleotide having an open reading frame encoding a HA1 protein, a M1 protein, and a NS2 protein, obtained from influenza virus.

In some embodiments, a vaccine comprises at least one RNA (e.g., mRNA) polynucleotide having an open reading frame encoding a HA1 protein, a M2 protein, and a NS1 protein, obtained from influenza virus.

In some embodiments, a vaccine comprises at least one RNA (e.g., mRNA) polynucleotide having an open reading frame encoding a HA1 protein, a M2 protein, and a NS2 protein, obtained from influenza virus.

In some embodiments, a vaccine comprises at least one RNA (e.g., mRNA) polynucleotide having an open reading frame encoding a HA1 protein, a NS1 protein, and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), and a NA protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2) and a M1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2) and a M2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2) and a NS1 protein obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2) and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NP protein, and a NA protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NP protein, and a M1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NP protein, and a M2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NP protein, and a NS1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NP protein and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NA protein, and a M1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NA protein, and a M2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NA protein, and a NS1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NA protein, and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a M1 protein, and a M2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a M1 protein, and a NS1 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a M1 protein, and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a M2 protein, and a NS1 protein, obtained from influenza virus.

In some embodiments, a vaccine comprises at least one RNA (e.g., mRNA) polynucleotide having an open reading frame encoding a H HA protein (HA or derivatives thereof comprising antigenic sequences from HA1 and/or HA2), a M2 protein, and a NS2 protein, obtained from influenza virus.

In some embodiments, a vaccine comprises at least one RNA (e.g., mRNA) polynucleotide having an open reading frame encoding a HA protein (HA or derivatives thereof comprising antigenic sequences from HA1 and/or HA2), a NS1 protein, and a NS2 protein, obtained from influenza virus.

It should be understood that the present disclosure is not intended to be limited by a particular strain of influenza virus. The strain of influenza virus used, as provided herein, may be any strain of influenza virus. Examples of preferred strains of influenza virus and preferred influenza antigens are provided in Tables 7-13 below.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H1/PuertoRico/8/1934.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H1/New Caledonia/20/1999.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H1/California/04/2009.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H5/Vietnam/1194/2004.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H2/Japan/305/1957.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H9/Hong Kong/1073/99.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H3/Aichi/2/1968.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H3/Brisbane/10/2007.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H7/Anhui/1/2013.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H10/Jiangxi-Donghu/346/2013.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H3/Wisconsin/67/2005.

In some embodiments, a vaccine comprises at least one RNA (e.g., mRNA) polynucleotide having an open reading frame encoding an influenza antigenic polypeptide (e.g., a HA protein, a NP protein, a NA protein, a M1 protein, a M2 protein, a NS1 protein, a NS2 protein, an immunogenic fragment of any of the foregoing influenza antigens, a variant or homolog of any of the foregoing influenza antigens, or any combination of two or more of the foregoing influenza antigens, variants or homologs) obtained from H1/Vietnam/850/2009.

In some embodiments, a vaccine comprises at least one RNA (e.g., mRNA) polynucleotide having an open reading frame encoding influenza H7N9 HA1 protein, ferritin and a dendritic cell targeting peptide (see, e.g., Ren X et al. *Emerg Infect Dis* 2013; 19(11):1881-84; Steel J et al. *mBio* 2010; 1(1):e00018-10; Kanekiyo M. et al. *Nature* 2013; 499:102-6, each of which is incorporated herein by reference).

In some embodiments, a vaccine comprises at least one RNA (e.g., mRNA) polynucleotide having an open reading frame encoding an avian influenza H7 HA protein.

In some embodiments, a vaccine comprises at least one RNA (e.g., mRNA) polynucleotide having an open reading frame encoding influenza H7 HA1 protein (see, e.g., Steel J et al. *mBio* 2010; 1(1):e00018-10).

In some embodiments, a vaccine comprises at least one RNA (e.g., mRNA) polynucleotide having an open reading frame encoding influenza H7N9 HA1 protein and ferritin (see, e.g., Kanekiyo M. et al. *Nature* 2013; 499:102-6).

In some embodiments, a vaccine comprises at least one RNA (e.g., mRNA) polynucleotide having an open reading frame encoding an influenza H5N1 protein. In some embodiments, the influenza H5N1 protein is from a human strain.

In some embodiments, a vaccine comprises at least one RNA (e.g., mRNA) polynucleotide having an open reading frame encoding an influenza H1N1 protein.

In some embodiments, a vaccine comprises at least one RNA (e.g., mRNA) polynucleotide having an open reading frame encoding an influenza protein from an influenza A strain, such as human H1N1, H5N1, H9N2 or H3N2.

In some embodiments, a vaccine comprises at least one RNA (e.g., mRNA) polynucleotide having an open reading frame encoding an influenza H1N1 HA having a nanoscaffold (see, e.g., Walker A et al. *Sci Rep* 2011:1(5):1-8, incorporated herein by reference).

In some embodiments, a vaccine comprises at least one RNA (e.g., mRNA) polynucleotide having an open reading frame encoding a glycosylated influenza H1N1 HA (see, e.g., Chen J et al. *PNAS USA* 2014; 111(7):2476-81, incorporated herein by reference).

An influenza vaccine may comprise, for example, at least one RNA (e.g., mRNA) polynucleotide having an open reading frame encoding at least one influenza HA2 stem antigen selected from the influenza HA2 stem antigens, provided herein, for example, those listed in Table 16, comprising an amino acid sequence identified by any one of SEQ ID NO: 394-412.

The present disclosure also encompasses an influenza vaccine comprising, for example, at least one RNA (e.g., mRNA) polynucleotide having a nucleic acid sequence selected from the influenza sequences listed in SEQ ID NO: 491-503 or 566-569 (see also: Mallajosyula V V et al., *Front Immunol.* 2015 Jun. 26; 6:329; Mallajosyula V V et al., Proc Natl Acad Sci USA. 2014 Jun. 24; 111(25):E2514-23; Bommakanti G, et al., *J Virol.* 2012 December; 86(24): 13434-44; Bommakanti G et al., *Proc Natl Acad Sci USA.* 2010 Aug. 3; 107(31):13701-6 and Yassine et al., *Nat Med.* 2015 September; 21(9):1065-70; Impagliazzo et al., *Science,* 2015 Sep. 18; 349(6254)).

The entire contents of International Application No. PCT/US2015/027400, International Publication No. WO2015/164674A, is incorporated herein by reference.

In some embodiments the vaccines described herein are consensus sequences. A "consensus sequence" as used herein refers to a polypeptide sequence based on analysis of an alignment of multiple subtypes of a particular influenza antigen. mRNA sequences that encode a consensus polypeptide sequence may be prepared and used to induce broad immunity against multiple subtypes or serotypes of a particular influenza antigen.

The mRNA encoding influenza antigens provided herein can be arranged as a vaccine that causes seroconversion in vaccinated mammals and provides cross-reactivity against a broad range of seasonal strains of influenza and also pandemic strains of influenza. The seroconversion and broad cross-reactivity can be determined by measuring inhibiting titers against different hemagglutinin strains of influenza. Preferred combinations include at least two antigens from each of the influenza antigens described herein.

It has been discovered that the mRNA vaccines described herein are superior to current vaccines in several ways. First, the lipid nanoparticle (LNP) delivery is superior to other formulations including a protamine base approach described in the literature and no additional adjuvants are to be necessary. The use of LNPs enables the effective delivery of chemically modified or unmodified mRNA vaccines. Additionally it has been demonstrated herein that both modified and unmodified LNP formulated mRNA vaccines were superior to conventional vaccines by a significant degree. In some embodiments the mRNA vaccines of the invention are superior to conventional vaccines by a factor of at least 10 fold, 20 fold, 40 fold, 50 fold, 100 fold, 500 fold or 1,000 fold.

Although attempts have been made to produce functional RNA vaccines, including mRNA vaccines and self-replicating RNA vaccines, the therapeutic efficacy of these RNA vaccines have not yet been fully established. Quite surprisingly, the inventors have discovered, according to aspects of the invention a class of formulations for delivering mRNA vaccines in vivo that results in significantly enhanced, and in many respects synergistic, immune responses including enhanced antigen generation and functional antibody production with neutralization capability. These results can be achieved even when significantly lower doses of the mRNA are administered in comparison with mRNA doses used in other classes of lipid based formulations. The formulations of the invention have demonstrated significant unexpected in vivo immune responses sufficient to establish the efficacy of functional mRNA vaccines as prophylactic and therapeutic agents. Additionally, self-replicating RNA vaccines rely on viral replication pathways to deliver enough RNA to a cell to produce an immunogenic response. The formulations of the invention do not require viral replication to produce enough protein to result in a strong immune response. Thus, the mRNA of the invention are not self-replicating RNA and do not include components necessary for viral replication.

The invention involves, in some aspects, the surprising finding that lipid nanoparticle (LNP) formulations significantly enhance the effectiveness of mRNA vaccines, including chemically modified and unmodified mRNA vaccines. The efficacy of mRNA vaccines formulated in LNP was examined in vivo using several distinct antigens. The results presented herein demonstrate the unexpected superior efficacy of the mRNA vaccines formulated in LNP over other commercially available vaccines.

In addition to providing an enhanced immune response, the formulations of the invention generate a more rapid immune response with fewer doses of antigen than other vaccines tested. The mRNA-LNP formulations of the invention also produce quantitatively and qualitatively better immune responses than vaccines formulated in a different carriers.

The data described herein demonstrate that the formulations of the invention produced significant unexpected improvements over existing antigen vaccines. Additionally, the mRNA-LNP formulations of the invention are superior to other vaccines even when the dose of mRNA is lower than other vaccines. mRNA encoding HA protein sequences such as HA stem sequences from different strains have been demonstrated to induce serum antibodies that bind to diverse panel of recombinant HA (rHA) proteins. The vaccine efficacy in mice was similar at all vaccine doses, as well as with all co-formulation and co-delivery methods assessed.

The LNP used in the studies described herein has been used previously to deliver siRNA in various animal models as well as in humans. In view of the observations made in association with the siRNA delivery of LNP formulations, the fact that LNP is useful in vaccines is quite surprising. It has been observed that therapeutic delivery of siRNA formulated in LNP causes an undesirable inflammatory response associated with a transient IgM response, typically leading to a reduction in antigen production and a compromised immune response. In contrast to the findings observed with siRNA, the LNP-mRNA formulations of the invention are demonstrated herein to generate enhanced IgG levels, sufficient for prophylactic and therapeutic methods rather than transient IgM responses.

Nucleic Acids/Polynucleotides

Influenza virus vaccines, as provided herein, comprise at least one (one or more) ribonucleic acid (RNA) (e.g., mRNA) polynucleotide having an open reading frame encoding at least one Influenza antigenic polypeptide. The term "nucleic acid" includes any compound and/or substance that comprises a polymer of nucleotides (nucleotide monomer). These polymers are referred to as polynucleotides. Thus, the terms "nucleic acid" and "polynucleotide" are used interchangeably.

Nucleic acids may be or may include, for example, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or chimeras or combinations thereof.

In some embodiments, polynucleotides of the present disclosure function as messenger RNA (mRNA). "Messenger RNA" (mRNA) refers to any polynucleotide that encodes a (at least one) polypeptide (a naturally-occurring, non-naturally-occurring, or modified polymer of amino acids) and can be translated to produce the encoded polypeptide in vitro, in vivo, in situ or ex vivo. The skilled artisan will appreciate that, except where otherwise noted, polynucleotide sequences set forth in the instant application will recite "T"s in a representative DNA sequence but where the sequence represents RNA (e.g., mRNA), the "T"s would be substituted for "U"s. Thus, any of the RNA polynucleotides encoded by a DNA identified by a particular sequence identification number may also comprise the corresponding RNA (e.g., mRNA) sequence encoded by the DNA, where each "T" of the DNA sequence is substituted with "U."

It should be understood that the mRNA polynucleotides of the vaccines as provided herein are synthetic molecules, i.e., they are not naturally-occurring molecules. That is, the mRNA polynucleotides of the present disclosure are isolated mRNA polynucleotides. As is known in the art, "isolated polynucleotides" refer to polynucleotides that are substantially physically separated from other cellular material (e.g., separated from cells and/or systems that produce the polynucleotides) or from other material that hinders their use in the vaccines of the present disclosure. Isolated polynucleotides are substantially pure in that they have been substantially separated from the substances with which they may be associated in living or viral systems. Thus, mRNA polynucleotide vaccines are not associated with living or viral systems, such as cells or viruses. The mRNA polynucleotide vaccines do not include viral components (e.g., viral capsids, viral enzymes, or other viral proteins, for example, those needed for viral-based replication), and the mRNA polynucleotide vaccines are not packaged within, encapsulated within, linked to, or otherwise associated with a virus or viral particle. In some embodiments, the mRNA vaccines comprise a lipid nanoparticle that consists of, or consists essentially of, one or more mRNA polynucleotides (e.g., mRNA polynucleotides encoding one or more influenza antigen(s)).

The basic components of an mRNA molecule typically include at least one coding region, a 5' untranslated region (UTR), a 3' UTR, a 5' cap and a poly-A tail. Polynucleotides of the present disclosure may function as mRNA but can be distinguished from wild-type mRNA in their functional and/or structural design features, which serve to overcome existing problems of effective polypeptide expression using nucleic-acid based therapeutics. In some embodiments, the RNA is a mRNA having an open reading frame encoding at least one influenza virus antigen. In some embodiments, the RNA (e.g., mRNA) further comprises a (at least one) 5' UTR, 3' UTR, a polyA tail and/or a 5' cap.

In some embodiments, a RNA polynucleotide of an RNA (e.g., mRNA) vaccine encodes 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9 or 9-10 antigenic polypeptides. In some embodiments, a RNA (e.g., mRNA) polynucleotide of an influenza vaccine encodes at least 10, 20, 30, 40, 50, 60, 70, 80, 90 or 100 antigenic polypeptides. In some embodiments, a RNA (e.g., mRNA) polynucleotide of an influenza vaccine encodes at least 100 or at least 200 antigenic polypeptides. In some embodiments, a RNA polynucleotide of an influenza vaccine encodes 1-10, 5-15, 10-20, 15-25, 20-30, 25-35, 30-40, 35-45, 40-50, 1-50, 1-100, 2-50 or 2-100 antigenic polypeptides.

Polynucleotides of the present disclosure, in some embodiments, are codon optimized. Codon optimization methods are known in the art and may be used as provided herein. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g. glycosylation sites); add, remove or shuffle protein domains; insert or delete restriction sites; modify ribosome binding sites and mRNA degradation sites; adjust translational rates to allow the various domains of the protein to fold properly; or to reduce or eliminate problem secondary structures within the polynucleotide. Codon optimization tools, algorithms and services are known in the art—non-limiting examples include services from GeneArt (Life Technologies), DNA2.0 (Menlo Park Calif.) and/or proprietary methods. In some embodiments, the open reading frame (ORF) sequence is optimized using optimization algorithms.

In some embodiments, a codon optimized sequence shares less than 95% sequence identity, less than 90% sequence identity, less than 85% sequence identity, less than 80% sequence identity, or less than 75% sequence identity to a naturally-occurring or wild-type sequence (e.g., a naturally-occurring or wild-type mRNA sequence encoding a polypeptide or protein of interest (e.g., an antigenic protein or antigenic polypeptide)).

In some embodiments, a codon-optimized sequence shares between 65% and 85% (e.g., between about 67% and about 85%, or between about 67% and about 80%) sequence identity to a naturally-occurring sequence or a wild-type sequence (e.g., a naturally-occurring or wild-type mRNA sequence encoding a polypeptide or protein of interest (e.g., an antigenic protein or polypeptide)). In some embodiments, a codon-optimized sequence shares between 65% and 75%, or about 80% sequence identity to a naturally-occurring sequence or wild-type sequence (e.g., a naturally-occurring or wild-type mRNA sequence encoding a polypeptide or protein of interest (e.g., an antigenic protein or polypeptide)).

In some embodiments a codon-optimized RNA (e.g., mRNA) may, for instance, be one in which the levels of G/C are enhanced. The G/C-content of nucleic acid molecules may influence the stability of the RNA. RNA having an increased amount of guanine (G) and/or cytosine (C) residues may be functionally more stable than nucleic acids containing a large amount of adenine (A) and thymine (T) or uracil (U) nucleotides. WO2002/098443 discloses a pharmaceutical composition containing an mRNA stabilized by sequence modifications in the translated region. Due to the degeneracy of the genetic code, the modifications work by substituting existing codons for those that promote greater RNA stability without changing the resulting amino acid. The approach is limited to coding regions of the RNA.

Antigens/Antigenic Polypeptides

In some embodiments, an antigenic polypeptide (e.g., at least one Influenza antigenic polypeptide) is longer than 25 amino acids and shorter than 50 amino acids. The term "antigenic polypeptides" and "antigenic proteins" includes immunogenic fragments and epitopes thereof (e.g., an immunogenic fragment capable of inducing an immune response to influenza). Polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. Polypeptides may also comprise single chain polypeptides or multichain polypeptides, such as antibodies or insulin, and may be associated or linked to each other. Most commonly, disulfide linkages are found in multichain polypeptides. The term "polypeptide" may also apply to amino acid polymers in which at least one amino acid residue is an artificial chemical analogue of a corresponding naturally-occurring amino acid.

A "polypeptide variant" is a molecule that differs in its amino acid sequence relative to a native sequence or a reference sequence. Amino acid sequence variants may possess substitutions, deletions, insertions, or a combination of any two or three of the foregoing, at certain positions within the amino acid sequence, as compared to a native sequence or a reference sequence. Ordinarily, variants possess at least 50% identity to a native sequence or a reference sequence. In some embodiments, variants share at least 80% identity or at least 90% identity with a native sequence or a reference sequence.

In some embodiments "variant mimics" are provided. A "variant mimic" contains at least one amino acid that would mimic an activated sequence. For example, glutamate may serve as a mimic for phosphoro-threonine and/or phosphoro-serine. Alternatively, variant mimics may result in deactivation or in an inactivated product containing the mimic. For example, phenylalanine may act as an inactivating substitution for tyrosine, or alanine may act as an inactivating substitution for serine.

"Orthologs" refers to genes in different species that evolved from a common ancestral gene by speciation. Normally, orthologs retain the same function in the course of evolution. Identification of orthologs is important for reliable prediction of gene function in newly sequenced genomes.

"Analogs" is meant to include polypeptide variants that differ by one or more amino acid alterations, for example, substitutions, additions or deletions of amino acid residues that still maintain one or more of the properties of the parent or starting polypeptide.

The present disclosure provides several types of compositions that are polynucleotide or polypeptide based, including variants and derivatives. These include, for example, substitutional, insertional, deletion and covalent variants and derivatives. The term "derivative" is synonymous with the term "variant" and generally refers to a molecule that has been modified and/or changed in any way relative to a reference molecule or a starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this disclosure. For example, sequence tags or amino acids, such as one or more lysines, can be added to peptide sequences (e.g., at the N-terminal or C-terminal ends). Sequence tags can be used for peptide detection, purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal residues or N-terminal residues) alternatively may be deleted depending on the use of the sequence, as for example, expression of the sequence as part of a larger sequence that is soluble, or linked to a solid support.

"Substitutional variants" when referring to polypeptides are those that have at least one amino acid residue in a native or starting sequence removed and a different amino acid inserted in its place at the same position. Substitutions may be single, where only one amino acid in the molecule has been substituted, or they may be multiple, where two or more (e.g., 3, 4 or 5) amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Features" when referring to polypeptide or polynucleotide are defined as distinct amino acid sequence-based or nucleotide-based components of a molecule respectively. Features of the polypeptides encoded by the polynucleotides include surface manifestations, local conformational shape, folds, loops, half-loops, domains, half-domains, sites, termini and any combination(s) thereof.

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the terms "site" as it pertains to amino acid based embodiments is used synonymously with "amino acid residue" and "amino acid side chain." As used herein when referring to polynucleotides the terms "site" as it pertains to nucleotide based embodiments is used synonymously with "nucleotide." A site represents a position within a peptide or polypeptide or polynucleotide that may be modified, manipulated, altered, derivatized or varied within the polypeptide-based or polynucleotide-based molecules.

As used herein the terms "termini" or "terminus" when referring to polypeptides or polynucleotides refers to an extremity of a polypeptide or polynucleotide respectively. Such extremity is not limited only to the first or final site of the polypeptide or polynucleotide but may include additional amino acids or nucleotides in the terminal regions. Polypeptide-based molecules may be characterized as having both an N-terminus (terminated by an amino acid with a free amino group (NH2)) and a C-terminus (terminated by an amino acid with a free carboxyl group (COOH)). Proteins are in some cases made up of multiple polypeptide chains brought together by disulfide bonds or by non-covalent forces (multimers, oligomers). These proteins have multiple N- and C-termini. Alternatively, the termini of the polypeptides may be modified such that they begin or end, as the case may be, with a non-polypeptide based moiety such as an organic conjugate.

As recognized by those skilled in the art, protein fragments, functional protein domains, and homologous proteins are also considered to be within the scope of polypeptides of interest. For example, provided herein is any protein fragment (meaning a polypeptide sequence at least one amino acid residue shorter than a reference polypeptide sequence but otherwise identical) of a reference protein having a length of 10, 20, 30, 40, 50, 60, 70, 80, 90, 100 or longer than 100 amino acids. In another example, any protein that includes a stretch of 20, 30, 40, 50, or 100 (contiguous) amino acids that are 40%, 50%, 60%, 70%, 80%, 90%, 95%, or 100% identical to any of the sequences described herein can be utilized in accordance with the disclosure. In some embodiments, a polypeptide includes 2, 3, 4, 5, 6, 7, 8, 9, 10, or more mutations as shown in any of the sequences provided herein or referenced herein. In another example, any protein that includes a stretch of 20, 30, 40, 50, or 100 amino acids that are greater than 80%, 90%, 95%, or 100% identical to any of the sequences described herein, wherein the protein has a stretch of 5, 10, 15, 20, 25, or 30 amino acids that are less than 80%, 75%, 70%, 65% to 60% identical to any of the sequences described herein can be utilized in accordance with the disclosure.

Polypeptide or polynucleotide molecules of the present disclosure may share a certain degree of sequence similarity or identity with the reference molecules (e.g., reference polypeptides or reference polynucleotides), for example, with art-described molecules (e.g., engineered or designed molecules or wild-type molecules). The term "identity," as known in the art, refers to a relationship between the sequences of two or more polypeptides or polynucleotides, as determined by comparing the sequences. In the art, identity also means the degree of sequence relatedness between two sequences as determined by the number of matches between strings of two or more amino acid residues or nucleic acid residues. Identity measures the percent of identical matches between the smaller of two or more sequences with gap alignments (if any) addressed by a particular mathematical model or computer program (e.g., "algorithms"). Identity of related peptides can be readily calculated by known methods. "% identity" as it applies to polypeptide or polynucleotide sequences is defined as the percentage of residues (amino acid residues or nucleic acid residues) in the candidate amino acid or nucleic acid sequence that are identical with the residues in the amino acid sequence or nucleic acid sequence of a second sequence after aligning the sequences and introducing gaps, if necessary, to achieve the maximum percent identity. Methods and computer programs for the alignment are well known in the art. Identity depends on a calculation of percent identity but may differ in value due to gaps and penalties introduced in the calculation. Generally, variants of a particular polynucleotide or polypeptide have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al. (1997). "Gapped BLAST and PSI-BLAST: a new generation of protein database search programs," *Nucleic Acids Res.* 25:3389-3402). Another popular local alignment technique is based on the Smith-Waterman algorithm (Smith, T. F. & Waterman, M. S. (1981) "Identification of common molecular subsequences." *J. Mol. Biol.* 147:195-197). A general global alignment technique based on dynamic programming is the Needleman-Wunsch algorithm (Needleman, S. B. & Wunsch, C. D. (1970) "A general method applicable to the search for similarities in the amino acid sequences of two proteins." *J. Mol. Biol.* 48:443-453). More recently, a Fast Optimal Global Sequence Alignment Algorithm (FOGSAA) was developed that purportedly produces global alignment of nucleotide and protein sequences faster than other optimal global alignment methods, including the Needleman-Wunsch algorithm. Other tools are described herein, specifically in the definition of "identity" below.

As used herein, the term "homology" refers to the overall relatedness between polymeric molecules, e.g. between nucleic acid molecules (e.g. DNA molecules and/or RNA molecules) and/or between polypeptide molecules. Polymeric molecules (e.g. nucleic acid molecules (e.g. DNA molecules and/or RNA molecules) and/or polypeptide molecules) that share a threshold level of similarity or identity determined by alignment of matching residues are termed homologous. Homology is a qualitative term that describes a relationship between molecules and can be based upon the quantitative similarity or identity. Similarity or identity is a quantitative term that defines the degree of sequence match between two compared sequences. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). Two polynucleotide sequences are considered homologous if the polypeptides they encode are at least 50%, 60%, 70%, 80%, 90%, 95%, or even 99% for at least one stretch of at least 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. Two protein sequences are considered homologous if the proteins are at least 50%, 60%, 70%, 80%, or 90% identical for at least one stretch of at least 20 amino acids.

Homology implies that the compared sequences diverged in evolution from a common origin. The term "homolog" refers to a first amino acid sequence or nucleic acid sequence (e.g., gene (DNA or RNA) or protein sequence) that is related to a second amino acid sequence or nucleic acid sequence by descent from a common ancestral sequence. The term "homolog" may apply to the relationship between genes and/or proteins separated by the event of speciation or to the relationship between genes and/or proteins separated by the event of genetic duplication. "Orthologs" are genes (or proteins) in different species that evolved from a common ancestral gene (or protein) by speciation. Typically, orthologs retain the same function in the course of evolution. "Paralogs" are genes (or proteins) related by duplication within a genome. Orthologs retain the same function in the course of evolution, whereas paralogs evolve new functions, even if these are related to the original one.

The term "identity" refers to the overall relatedness between polymeric molecules, for example, between polynucleotide molecules (e.g. DNA molecules and/or RNA molecules) and/or between polypeptide molecules. Calculation of the percent identity of two polynucleic acid sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleic acid sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleic acid sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleic acid sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM *J Applied Math.*, 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12, 387 (1984)), BLASTP, BLASTN, and FASTA Altschul, S. F. et al., *J. Molec. Biol.*, 215, 403 (1990)).

Multiprotein and Multicomponent Vaccines

The present disclosure encompasses influenza vaccines comprising multiple RNA (e.g., mRNA) polynucleotides, each encoding a single antigenic polypeptide, as well as influenza vaccines comprising a single RNA polynucleotide encoding more than one antigenic polypeptide (e.g., as a fusion polypeptide). Thus, a vaccine composition comprising a RNA (e.g., mRNA) polynucleotide having an open reading frame encoding a first antigenic polypeptide and a RNA (e.g., mRNA) polynucleotide having an open reading frame encoding a second antigenic polypeptide encompasses (a) vaccines that comprise a first RNA polynucleotide encoding a first antigenic polypeptide and a second RNA polynucleotide encoding a second antigenic polypeptide, and (b) vaccines that comprise a single RNA polynucleotide encoding a first and second antigenic polypeptide (e.g., as a fusion polypeptide). RNA (e.g., mRNA) vaccines of the present disclosure, in some embodiments, comprise 2-10 (e.g., 2, 3, 4, 5, 6, 7, 8, 9 or 10), or more, RNA polynucleotides having an open reading frame, each of which encodes a different antigenic polypeptide (or a single RNA polynucleotide encoding 2-10, or more, different antigenic polypeptides). The antigenic polypeptides may be selected from any of the influenza antigenic polypeptides described herein.

In some embodiments, a multicomponent vaccine comprises at least one RNA (e.g., mRNA) polynucleotide encoding at least one influenza antigenic polypeptide fused to a signal peptide (e.g., SEQ ID NO: 488-490). The signal peptide may be fused at the N-terminus or the C-terminus of an antigenic polypeptide.

Signal Peptides

In some embodiments, antigenic polypeptides encoded by influenza RNA (e.g., mRNA) polynucleotides comprise a signal peptide. Signal peptides, comprising the N-terminal 15-60 amino acids of proteins, are typically needed for the translocation across the membrane on the secretory pathway and, thus, universally control the entry of most proteins both in eukaryotes and prokaryotes to the secretory pathway. Signal peptides generally include three regions: an N-terminal region of differing length, which usually comprises positively charged amino acids; a hydrophobic region; and a short carboxy-terminal peptide region. In eukaryotes, the signal peptide of a nascent precursor protein (pre-protein) directs the ribosome to the rough endoplasmic reticulum (ER) membrane and initiates the transport of the growing peptide chain across it for processing. ER processing produces mature proteins, wherein the signal peptide is cleaved from precursor proteins, typically by a ER-resident signal peptidase of the host cell, or they remain uncleaved and function as a membrane anchor. A signal peptide may also facilitate the targeting of the protein to the cell membrane. The signal peptide, however, is not responsible for the final destination of the mature protein. Secretory proteins devoid of additional address tags in their sequence are by default secreted to the external environment. During recent years, a more advanced view of signal peptides has evolved, showing that the functions and immunodominance of certain signal peptides are much more versatile than previously anticipated.

Influenza vaccines of the present disclosure may comprise, for example, RNA (e.g., mRNA) polynucleotides encoding an artificial signal peptide, wherein the signal peptide coding sequence is operably linked to and is in frame with the coding sequence of the antigenic polypeptide. Thus, influenza vaccines of the present disclosure, in some embodiments, produce an antigenic polypeptide fused to a signal peptide. In some embodiments, a signal peptide is fused to the N-terminus of the antigenic polypeptide. In some embodiments, a signal peptide is fused to the C-terminus of the antigenic polypeptide.

In some embodiments, the signal peptide fused to the antigenic polypeptide is an artificial signal peptide. In some embodiments, an artificial signal peptide fused to the antigenic polypeptide encoded by the RNA (e.g., mRNA) vaccine is obtained from an immunoglobulin protein, e.g., an IgE signal peptide or an IgG signal peptide. In some embodiments, a signal peptide fused to the antigenic polypeptide encoded by a RNA (e.g., mRNA) vaccine is an Ig heavy chain epsilon-1 signal peptide (IgE HC SP) having the sequence of: MDWTWILFLVAAATRVHS; SEQ ID NO: 481. In some embodiments, a signal peptide fused to the antigenic polypeptide encoded by the (e.g., mRNA) RNA (e.g., mRNA) vaccine is an IgGk chain V-III region HAH signal peptide (IgGk SP) having the sequence of MET-PAQLLFLLLLWLPDTTG; SEQ ID NO: 480. In some embodiments, the signal peptide is selected from: Japanese encephalitis PRM signal sequence (MLG-SNSGQRVVFTILLLLVAPAYS; SEQ ID NO: 482), VSVg protein signal sequence (MKCLLYLAFLFIGVNCA; SEQ ID NO: 483) and Japanese encephalitis JEV signal sequence (MWLVSLAIVTACAGA; SEQ ID NO: 484).

In some embodiments, the antigenic polypeptide encoded by a RNA (e.g., mRNA) vaccine comprises an amino acid sequence identified by any one of SEQ ID NO: 1-444, 458, 460, 462-479, or 543-565 (see also Tables 7-13 and 26) fused to a signal peptide identified by any one of SEQ ID NO: 480-484. The examples disclosed herein are not meant to be limiting and any signal peptide that is known in the art to facilitate targeting of a protein to ER for processing and/or targeting of a protein to the cell membrane may be used in accordance with the present disclosure.

A signal peptide may have a length of 15-60 amino acids. For example, a signal peptide may have a length of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 amino acids. In some embodiments, a signal peptide has a length of 20-60, 25-60, 30-60, 35-60, 40-60, 45-60, 50-60, 55-60, 15-55, 20-55, 25-55, 30-55, 35-55, 40-55, 45-55, 50-55, 15-50, 20-50, 25-50, 30-50, 35-50, 40-50, 45-50, 15-45, 20-45, 25-45, 30-45, 35-45, 40-45, 15-40, 20-40, 25-40, 30-40, 35-40, 15-35, 20-35, 25-35, 30-35, 15-30, 20-30, 25-30, 15-25, 20-25, or 15-20 amino acids.

A signal peptide is typically cleaved from the nascent polypeptide at the cleavage junction during ER processing. The mature antigenic polypeptide produce by an influenza RNA (e.g., mRNA) vaccine of the present disclosure typically does not comprise a signal peptide.

Chemical Modifications

Influenza vaccines of the present disclosure, in some embodiments, comprise at least RNA (e.g. mRNA) polynucleotide having an open reading frame encoding at least one antigenic polypeptide that comprises at least one chemical modification.

The terms "chemical modification" and "chemically modified" refer to modification with respect to adenosine (A), guanosine (G), uridine (U), thymidine (T) or cytidine (C) ribonucleosides or deoxyribonucleosides in at least one of their position, pattern, percent or population. Generally, these terms do not refer to the ribonucleotide modifications in naturally occurring 5'-terminal mRNA cap moieties. With respect to a polypeptide, the term "modification" refers to a modification relative to the canonical set 20 amino acids. Polypeptides, as provided herein, are also considered "modified" of they contain amino acid substitutions, insertions or a combination of substitutions and insertions.

Polynucleotides (e.g., RNA polynucleotides, such as mRNA polynucleotides), in some embodiments, comprise various (more than one) different modifications. In some embodiments, a particular region of a polynucleotide contains one, two or more (optionally different) nucleoside or nucleotide modifications. In some embodiments, a modified RNA polynucleotide (e.g., a modified mRNA polynucleotide), introduced to a cell or organism, exhibits reduced degradation in the cell or organism, respectively, relative to an unmodified polynucleotide. In some embodiments, a modified RNA polynucleotide (e.g., a modified mRNA polynucleotide), introduced into a cell or organism, may exhibit reduced immunogenicity in the cell or organism, respectively (e.g., a reduced innate response).

Modifications of polynucleotides include, without limitation, those described herein. Polynucleotides (e.g., RNA polynucleotides, such as mRNA polynucleotides) may comprise modifications that are naturally-occurring, non-naturally-occurring or the polynucleotide may comprise a combination of naturally-occurring and non-naturally-occurring modifications. Polynucleotides may include any useful modification, for example, of a sugar, a nucleobase, or an internucleoside linkage (e.g., to a linking phosphate, to a phosphodiester linkage or to the phosphodiester backbone).

Polynucleotides (e.g., RNA polynucleotides, such as mRNA polynucleotides), in some embodiments, comprise non-natural modified nucleotides that are introduced during synthesis or post-synthesis of the polynucleotides to achieve desired functions or properties. The modifications may be present on an internucleotide linkages, purine or pyrimidine bases, or sugars. The modification may be introduced with chemical synthesis or with a polymerase enzyme at the terminal of a chain or anywhere else in the chain. Any of the regions of a polynucleotide may be chemically modified.

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A nucleotide" refers to a nucleoside, including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphodiester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

Modifications of polynucleotides (e.g., RNA polynucleotides, such as mRNA polynucleotides) that are useful in the vaccines of the present disclosure include, but are not limited to the following: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6, N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl)adenine; 2-(halo)adenine; 2-(halo) adenine; 2-(propyl)adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl)cytosine; 5-(alkynyl)cytosine; 5-(halo)cytosine; 5-(propynyl) cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azido-cytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thioguanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methylguanosine; 7-deaza-8-aza-guanosine; 7-methyl-8-oxoguanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromo-guanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-methyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudo-uridine; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2 (thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio)pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl) pseudo-UTP; 1-Methyl-pseudo-UTP; 2 (thio)pseudouracil; 2' deoxy uridine; 2' fluorouridine; 2-(thio)uracil; 2,4-(dithio) psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio)pseudouracil; 4-(thio)uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio) uracil; 5 (propynyl)uracil; 5 (trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio) pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl) uracil; 5-(guanidiniumalkyl)uracil; 5-(halo)uracil; 5-(1,3-diazole-1-alkyl)uracil; 5-(methoxy)uracil;

5-(methoxycarbonylmethyl)-2-(thio)uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio) uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl) pseudouridine TP; (E)-5-(2-Bromo-vinyl)ara-uridine TP; (E)-5-(2-Bromo-vinyl)uridine TP; (Z)-5-(2-Bromo-vinyl) ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl) pseudo-UTP; 1-(2-Amino-2-carboxyethyl)pseudo-UTP; 1-(2-Amino-ethyl)pseudo-UTP; 1-(2-Hydroxyethyl) pseudouridine TP; 1-(2-Methoxyethyl)pseudouridine TP; 1-(3,4-Bis-trifluoromethoxybenzyl)pseudouridine TP; 1-(3, 4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl) pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl) pseudouridine TP; 1-(4-Fluorobenzyl)pseudouridine TP; 1-(4-Iodobenzyl)pseudouridine TP; 1-(4-Methanesulfonylbenzyl)pseudouridine TP; 1-(4-Methoxybenzyl)pseudouridine TP; 1-(4-Methoxy-benzyl)pseudo-UTP; 1-(4-Methoxyphenyl)pseudo-UTP; 1-(4-Methylbenzyl)pseudouridine TP; 1-(4-Methyl-benzyl)pseudo-UTP; 1-(4-Nitrobenzyl) pseudouridine TP; 1-(4-Nitro-benzyl)pseudo-UTP; 1(4-Nitro-phenyl)pseudo-UTP; 1-(4-Thiomethoxybenzyl) pseudouridine TP; 1-(4-Trifluoromethoxybenzyl) pseudouridine TP; 1-(4-Trifluoromethylbenzyl) pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl} pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl) pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenylpseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxy}]propionic acid; Pseudouridine TP 1-[3-{2-(2-[2-{2 (2-ethoxy)-ethoxy}-ethoxy]-ethoxy)-ethoxy}]propionic acid; Pseudouridine TP 1-[3-{2-(2-[2-ethoxy]-ethoxy)-ethoxy}]propionic acid; Pseudouridine TP 1-[3-{2-(2-ethoxy)-ethoxy}]propionic acid; Pseudouridine TP 1-methylphosphonic acid; Pseudouridine TP 1-methylphosphonic acid diethyl ester; Pseudo-UTP-NL-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl: 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluoro-cytidine; 2' methyl, 2'amino, 2'azido, 2'fluoro-adenine; 2'methyl, 2'amino, 2'azido, 2'fluoro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl)isocarbostyrilyl; 3-(methyl)isocarbostyrilyl; 4-(fluoro)-6-(methyl)benzimidazole; 4-(methyl) benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl) isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of pseudouridine (ψ), N1-methylpseudouridine (m$^1$ψ), 2-thiouridine, N1-ethylpseudouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of 1-methyl-pseudouridine (m$^1$ψ), 5-methoxy-uridine (mo$^5$U), 5-methyl-cytidine (m$^5$C), pseudouridine (ψ), α-thio-guanosine and α-thio-adenosine. In some embodiments, polynucleotides includes a combination of at least two (e.g., 2, 3, 4 or more) of the aforementioned modified nucleobases.

In some embodiments, polynucleotides (e.g., RNA polynucleotides, such as mRNA polynucleotides) comprise pseudouridine (ψ) and 5-methyl-cytidine (m$^5$C). In some embodiments, polynucleotides (e.g., RNA polynucleotides, such as mRNA polynucleotides) comprise 1-methyl-pseudouridine (m$^1$ψ). In some embodiments, polynucleotides (e.g., RNA polynucleotides, such as mRNA polynucleotides) comprise 1-methyl-pseudouridine (m$^1$ψ) and 5-methyl-cytidine (m$^5$C). In some embodiments, polynucleotides (e.g., RNA polynucleotides, such as mRNA polynucleotides) comprise 2-thiouridine (s$^2$U). In some embodiments, polynucleotides (e.g., RNA polynucleotides, such as mRNA polynucleotides) comprise 2-thiouridine and 5-methyl-cytidine (m$^5$C). In some embodiments, polynucleotides (e.g., RNA polynucleotides, such as mRNA polynucleotides) comprise methoxy-uridine (mo$^5$U). In some embodiments, polynucleotides (e.g., RNA polynucleotides, such as mRNA polynucleotides) comprise 5-methoxy-uridine (mo$^5$U) and 5-methyl-cytidine (m$^5$C). In some embodiments, polynucleotides (e.g., RNA polynucleotides, such as mRNA polynucleotides) comprise 2'-O-methyl uridine. In some embodiments polynucleotides (e.g., RNA polynucleotides, such as mRNA polynucleotides) comprise 2'-O-methyl uridine and 5-methyl-cytidine (m$^5$C). In some embodiments, polynucleotides (e.g., RNA polynucleotides, such as mRNA polynucleotides) comprise N6-methyl-adenosine ($m^6A$). In some embodiments, polynucleotides (e.g., RNA polynucleotides, such as mRNA polynucleotides) comprise N6-methyl-adenosine ($m^6A$) and 5-methyl-cytidine ($m^5C$).

In some embodiments, polynucleotides (e.g., RNA polynucleotides, such as mRNA polynucleotides) are uniformly modified (e.g., fully modified, modified throughout the entire sequence) for a particular modification. For example, a polynucleotide can be uniformly modified with 5-methyl-cytidine ($m^5C$), meaning that all cytosine residues in the mRNA sequence are replaced with 5-methyl-cytidine ($m^5C$). Similarly, a polynucleotide can be uniformly modified for any type of nucleoside residue present in the sequence by replacement with a modified residue such as those set forth above.

Exemplary nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), and 2-thio-5-methyl-cytidine.

In some embodiments, a modified nucleobase is a modified uridine. Exemplary nucleobases and In some embodiments, a modified nucleobase is a modified cytosine. nucleosides having a modified uridine include 5-cyano uridine, and 4'-thio uridine.

In some embodiments, a modified nucleobase is a modified adenine. Exemplary nucleobases and nucleosides having a modified adenine include 7-deaza-adenine, 1-methyl-adenosine (m1A), 2-methyl-adenine (m2A), and N6-methyl-adenosine (m6A).

In some embodiments, a modified nucleobase is a modified guanine. Exemplary nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

The polynucleotides of the present disclosure may be partially or fully modified along the entire length of the molecule. For example, one or more or all or a given type of nucleotide (e.g., purine or pyrimidine, or any one or more or all of A, G, U, C) may be uniformly modified in a polynucleotide of the invention, or in a given predetermined sequence region thereof (e.g., in the mRNA including or excluding the polyA tail). In some embodiments, all nucleotides X in a polynucleotide of the present disclosure (or in a given sequence region thereof) are modified nucleotides, wherein X may any one of nucleotides A, G, U, C, or any one of the combinations A+G, A+U, A+C, G+U, G+C, U+C, A+G+U, A+G+C, G+U+C or A+G+C.

The polynucleotide may contain from about 1% to about 100% modified nucleotides (either in relation to overall nucleotide content, or in relation to one or more types of nucleotide, i.e., any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%). Any remaining percentage is accounted for by the presence of unmodified A, G, U, or C.

The polynucleotides may contain at a minimum 1% and at maximum 100% modified nucleotides, or any intervening percentage, such as at least 5% modified nucleotides, at least 10% modified nucleotides, at least 25% modified nucleotides, at least 50% modified nucleotides, at least 80% modified nucleotides, or at least 90% modified nucleotides. For example, the polynucleotides may contain a modified pyrimidine such as a modified uracil or cytosine. In some embodiments, at least 5%, at least 10%, at least 25%, at least 50%, at least 80%, at least 90% or 100% of the uracil in the polynucleotide is replaced with a modified uracil (e.g., a 5-substituted uracil). The modified uracil can be replaced by a compound having a single unique structure, or can be replaced by a plurality of compounds having different structures (e.g., 2, 3, 4 or more unique structures). In some embodiments, at least 5%, at least 10%, at least 25%, at least 50%, at least 80%, at least 90% or 100% of the cytosine in the polynucleotide is replaced with a modified cytosine (e.g., a 5-substituted cytosine). The modified cytosine can be replaced by a compound having a single unique structure, or can be replaced by a plurality of compounds having different structures (e.g., 2, 3, 4 or more unique structures).

Thus, in some embodiments, the RNA (e.g., mRNA) vaccines comprise a 5'UTR element, an optionally codon optimized open reading frame, and a 3'UTR element, a poly(A) sequence and/or a polyadenylation signal wherein the RNA is not chemically modified.

In some embodiments, the modified nucleobase is a modified uracil. Exemplary nucleobases and nucleosides having a modified uracil include pseudouridine (ψ), pyridin-4-one ribonucleoside, 5-aza-uridine, 6-aza-uridine, 2-thio-5-aza-uridine, 2-thio-uridine ($s^2U$), 4-thio-uridine ($s^4U$), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s^2U$), 5-aminomethyl-2-thio-uridine ($nm^5s^2U$), 5-methylaminomethyl-uridine ($mnm^5U$), 5-methylaminomethyl-2-thio-uridine ($mnm^5s^2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s^2U$), 5-propynyl-uridine, 1-propynyl-pseudouridine, 5-taurinomethyl-uridine ($τm^5U$), 1-taurinomethyl-pseudouridine, 5-taurinomethyl-2-thio-uridine ($τm^5s^2U$), 1-taurinomethyl-4-thio-pseudouridine, 5-methyl-uridine ($m^5U$, i.e., having the nucleobase deoxythymine), 1-methyl-pseudouridine ($m^1ψ$), 5-methyl-2-thio-uridine ($m^5s^2U$), 1-methyl-4-thio-pseudouridine ($m^1s^4ψ$), 4-thio-1-methyl-pseudouridine, 3-methyl-pseudouridine ($m^3ψ$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp³U), 1-methyl-3-(3-amino-3-carboxypropyl)pseudouridine (acp³ψ), 5-(isopentenylaminomethyl)uridine (inm⁵U), 5-(isopentenylaminomethyl)-2-thio-uridine (inm⁵s²U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s²Um), 5-methoxycarbonylmethyl-2'-O-methyl-uridine (mcm⁵Um), 5-carbamoylmethyl-2'-O-methyl-uridine (ncm⁵Um), 5-carboxymethylaminomethyl-2'-O-methyl-uridine (cmnm⁵Um), 3,2'-O-dimethyl-uridine (m³Um), and 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino)] uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine (m³C), N4-acetyl-cytidine (ac⁴C), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s²C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k₂C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

In some embodiments, the modified nucleobase is a modified adenine. Exemplary nucleobases and nucleosides having a modified adenine include 2-amino-purine, 2, 6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenine (m²A), N6-methyl-adenosine (m⁶A), 2-methylthio-N6-methyl-adenosine (ms²m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl) adenosine (ms²io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms²hn⁶A), N6-acetyl-adenosine (ac⁶A), 7-methyl-adenine, 2-methylthio-adenine, 2-methoxy-adenine, α-thio-adenosine, 2'-O-methyl-adenosine (Am), N6,2'-O-dimethyl-adenosine (m⁶Am), N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

In some embodiments, the modified nucleobase is a modified guanine. Exemplary nucleobases and nucleosides having a modified guanine include inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OhyW), undermodified hydroxywybutosine (OhyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m¹G), N2-methyl-guanosine (m²G), N2,N2-dimethyl-guanosine (m²₂G), N2,7-dimethyl-guanosine (m²,⁷G), N2, N2,7-dimethyl-guanosine (m²,²,⁷G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m¹Gm), N2,7-dimethyl-2'-O-methyl-guanosine (m²,⁷Gm), 2'-O-methyl-inosine (Im), 1,2'-O-dimethyl-inosine (m¹Im), 2'-O-ribosylguanosine (phosphate) (Gr(p)), 1-thio-guanosine, O6-methyl-guanosine, 2'-F-ara-guanosine, and 2'-F-guanosine.

In Vitro Transcription of RNA (e.g., mRNA)

Influenza virus vaccines of the present disclosure comprise at least one RNA polynucleotide, such as a mRNA (e.g., modified mRNA). mRNA, for example, is transcribed in vitro from template DNA, referred to as an "in vitro transcription template." In some embodiments, an in vitro transcription template encodes a 5' untranslated (UTR) region, contains an open reading frame, and encodes a 3' UTR and a polyA tail. The particular nucleic acid sequence composition and length of an in vitro transcription template will depend on the mRNA encoded by the template.

A "5' untranslated region" (5'UTR) refers to a region of an mRNA that is directly upstream (i.e., 5') from the start codon (i.e., the first codon of an mRNA transcript translated by a ribosome) that does not encode a polypeptide.

A "3' untranslated region" (3'UTR) refers to a region of an mRNA that is directly downstream (i.e., 3') from the stop codon (i.e., the codon of an mRNA transcript that signals a termination of translation) that does not encode a polypeptide.

An "open reading frame" is a continuous stretch of DNA or RNA beginning with a start codon (e.g., methionine (ATG or AUG)), and ending with a stop codon (e.g., TAA, TAG or TGA, or UAA, UAG or UGA) and typically encodes a polypeptide (e.g., protein).

A "polyA tail" is a region of mRNA that is downstream, e.g., directly downstream (i.e., 3'), from the 3' UTR that contains multiple, consecutive adenosine monophosphates. A polyA tail may contain 10 to 300 adenosine monophosphates. For example, a polyA tail may contain 10, 20, 30, 40, 50, 60, 70, 80, 90, 100, 110, 120, 130, 140, 150, 160, 170, 180, 190, 200, 210, 220, 230, 240, 250, 260, 270, 280, 290 or 300 adenosine monophosphates. In some embodiments, a polyA tail contains 50 to 250 adenosine monophosphates. In a relevant biological setting (e.g., in cells, in vivo) the poly(A) tail functions to protect mRNA from enzymatic degradation, e.g., in the cytoplasm, and aids in transcription termination, export of the mRNA from the nucleus and translation.

In some embodiments, a polynucleotide includes 200 to 3,000 nucleotides. For example, a polynucleotide may include 200 to 500, 200 to 1000, 200 to 1500, 200 to 3000, 500 to 1000, 500 to 1500, 500 to 2000, 500 to 3000, 1000 to 1500, 1000 to 2000, 1000 to 3000, 1500 to 3000, or 2000 to 3000 nucleotides.

Flagellin Adjuvants

Flagellin is an approximately 500 amino acid monomeric protein that polymerizes to form the flagella associated with bacterial motion. Flagellin is expressed by a variety of flagellated bacteria (*Salmonella typhimurium* for example) as well as non-flagellated bacteria (such as *Escherichia coli*). Sensing of flagellin by cells of the innate immune system (dendritic cells, macrophages, etc.) is mediated by the Toll-like receptor 5 (TLR5) as well as by Nod-like receptors (NLRs) Ipaf and Naip5. TLRs and NLRs have been identified as playing a role in the activation of innate immune response and adaptive immune response. As such, flagellin provides an adjuvant effect in a vaccine.

The nucleotide and amino acid sequences encoding known flagellin polypeptides are publicly available in the NCBI GenBank database. The flagellin sequences from *S. typhimurium, H. pylori, V. cholera, S. marcesens, S. flexneri, T. pallidum, L. pneumophila, B. burgdorferei, C. difficile, R. meliloti, A. tumefaciens, R. lupini, B. clarridgeiae, P. mirabilis, B. subtilus, L. monocytogenes, P. aeruginosa*, and *E. coli*, among others are known.

A flagellin polypeptide, as used herein, refers to a full length flagellin protein, immunogenic fragments thereof, and peptides having at least 50% sequence identify to a flagellin protein or immunogenic fragments thereof. Exemplary flagellin proteins include flagellin from *Salmonella typhi* (UniPro Entry number: Q56086), *Salmonella typhimurium* (A0A0C9DG09), *Salmonella enteritidis* (A0A0C9BAB7), and *Salmonella choleraesuis* (Q6V2X8), and proteins having an amino acid sequence identified by any one of SEQ ID NO 1-444, 458, 460, 462-479, or 543-565 (see also Tables 7-13 and 26). In some embodiments, the flagellin polypeptide has at least 60%, 70%, 75%, 80%, 90%, 95%, 97%, 98%, or 99% sequence identify to a flagellin protein or immunogenic fragments thereof.

In some embodiments, the flagellin polypeptide is an immunogenic fragment. An immunogenic fragment is a portion of a flagellin protein that provokes an immune response. In some embodiments, the immune response is a TLR5 immune response. An example of an immunogenic fragment is a flagellin protein in which all or a portion of a hinge region has been deleted or replaced with other amino acids. For example, an antigenic polypeptide may be inserted in the hinge region. Hinge regions are the hypervariable regions of a flagellin. Hinge regions of a flagellin are also referred to as "D3 domain or region, "propeller domain or region," "hypervariable domain or region" and "variable domain or region." "At least a portion of a hinge region," as used herein, refers to any part of the hinge region of the flagellin, or the entirety of the hinge region. In other embodiments an immunogenic fragment of flagellin is a 20, 25, 30, 35, or 40 amino acid C-terminal fragment of flagellin.

The flagellin monomer is formed by domains D0 through D3. D0 and D1, which form the stem, are composed of tandem long alpha helices and are highly conserved among different bacteria. The D1 domain includes several stretches of amino acids that are useful for TLR5 activation. The entire D1 domain or one or more of the active regions within the domain are immunogenic fragments of flagellin. Examples of immunogenic regions within the D1 domain include residues 88-114 and residues 411-431 (in *Salmonella typhimurium* FliC flagellin. Within the 13 amino acids in the 88-100 region, at least 6 substitutions are permitted between *Salmonella* flagellin and other flagellins that still preserve TLR5 activation. Thus, immunogenic fragments of flagellin include flagellin like sequences that activate TLR5 and contain a 13 amino acid motif that is 53% or more identical to the *Salmonella* sequence in 88-100 of FliC (LQRVRELAVQSAN; SEQ ID NO: 504).

In some embodiments, the RNA (e.g., mRNA) vaccine includes an RNA that encodes a fusion protein of flagellin and one or more antigenic polypeptides. A "fusion protein" as used herein, refers to a linking of two components of the construct. In some embodiments, a carboxy-terminus of the antigenic polypeptide is fused or linked to an amino terminus of the flagellin polypeptide. In other embodiments, an amino-terminus of the antigenic polypeptide is fused or linked to a carboxy-terminus of the flagellin polypeptide. The fusion protein may include, for example, one, two, three, four, five, six or more flagellin polypeptides linked to one, two, three, four, five, six or more antigenic polypeptides. When two or more flagellin polypeptides and/or two or more antigenic polypeptides are linked such a construct may be referred to as a "multimer."

Each of the components of a fusion protein may be directly linked to one another or they may be connected through a linker. For instance, the linker may be an amino acid linker. The amino acid linker encoded for by the RNA (e.g., mRNA) vaccine to link the components of the fusion protein may include, for instance, at least one member selected from the group consisting of a lysine residue, a glutamic acid residue, a serine residue and an arginine residue. In some embodiments the linker is 1-30, 1-25, 1-25, 5-10, 5, 15, or 5-20 amino acids in length.

In other embodiments the RNA (e.g., mRNA) vaccine includes at least two separate RNA polynucleotides, one encoding one or more antigenic polypeptides and the other encoding the flagellin polypeptide. The at least two RNA polynucleotides may be co-formulated in a carrier such as a lipid nanoparticle.

Methods of Treatment

Provided herein are compositions (e.g., pharmaceutical compositions), methods, kits and reagents for prevention and/or treatment of influenza virus in humans and other mammals. Influenza virus RNA vaccines can be used as therapeutic or prophylactic agents. They may be used in medicine to prevent and/or treat infectious disease. In exemplary aspects, the influenza virus RNA vaccines of the present disclosure are used to provide prophylactic protection from influenza virus. Prophylactic protection from influenza virus can be achieved following administration of an influenza virus RNA vaccine of the present disclosure. Vaccines can be administered once, twice, three times, four times or more. It is possible, although less desirable, to administer the vaccine to an infected individual to achieve a therapeutic response. Dosing may need to be adjusted accordingly.

In some embodiments, the influenza virus vaccines of the present disclosure can be used as a method of preventing an influenza virus infection in a subject, the method comprising administering to said subject at least one influenza virus vaccine as provided herein. In some embodiments, the influenza virus vaccines of the present disclosure can be used as a method of inhibiting a primary influenza virus infection in a subject, the method comprising administering to said subject at least one influenza virus vaccine as provided herein. In some embodiments, the influenza virus vaccines of the present disclosure can be used as a method of treating an influenza virus infection in a subject, the method comprising administering to said subject at least one influenza virus vaccine as provided herein. In some embodiments, the influenza virus vaccines of the present disclosure can be used as a method of reducing an incidence of influenza virus infection in a subject, the method comprising administering to said subject at least one influenza virus vaccine as provided herein. In come embodiments, the influenza virus vaccines of the present disclosure can be used as a method of inhibiting spread of influenza virus from a first subject infected with influenza virus to a second subject not infected with influenza virus, the method comprising administering to at least one of said first subject sand said second subject at least one influenza virus vaccine as provided herein.

A method of eliciting an immune response in a subject against an influenza virus is provided in aspects of the invention. The method involves administering to the subject an influenza virus RNA vaccine comprising at least one RNA polynucleotide having an open reading frame encoding at least one influenza virus antigenic polypeptide, thereby inducing in the subject an immune response specific to influenza virus antigenic polypeptide, wherein anti-antigenic polypeptide antibody titer in the subject is increased following vaccination relative to anti-antigenic polypeptide antibody titer in a subject vaccinated with a prophylactically effective dose of a traditional vaccine against the influenza virus. An "anti-antigenic polypeptide antibody" is a serum antibody the binds specifically to the antigenic polypeptide.

A prophylactically effective dose is a therapeutically effective dose that prevents infection with the virus at a clinically acceptable level. In some embodiments the therapeutically effective dose is a dose listed in a package insert for the vaccine. A traditional vaccine, as used herein, refers to a vaccine other than the mRNA vaccines of the present disclosure. For instance, a traditional vaccine includes, but is not limited to, live microorganism vaccines, killed microorganism vaccines, subunit vaccines, protein antigen vaccines, DNA vaccines, VLP vaccines, etc. In exemplary embodiments, a traditional vaccine is a vaccine that has achieved regulatory approval and/or is registered by a national drug regulatory body, for example the Food and Drug Administration (FDA) in the United States or the European Medicines Agency (EMA).

In some embodiments the anti-antigenic polypeptide antibody titer in the subject is increased 1 log to 10 log following vaccination relative to anti-antigenic polypeptide antibody titer in a subject vaccinated with a prophylactically effective dose of a traditional vaccine against the influenza virus.

In some embodiments the anti-antigenic polypeptide antibody titer in the subject is increased 1 log, 2 log, 3 log, 5 log or 10 log following vaccination relative to anti-antigenic polypeptide antibody titer in a subject vaccinated with a prophylactically effective dose of a traditional vaccine against influenza.

A method of eliciting an immune response in a subject against an influenza virus is provided in other aspects of the present disclosure. The method involves administering to the subject an influenza virus RNA vaccine comprising at least one RNA polynucleotide having an open reading frame encoding at least one influenza virus antigenic polypeptide, thereby inducing in the subject an immune response specific to influenza virus antigenic polypeptide, wherein the immune response in the subject is equivalent to an immune response in a subject vaccinated with a traditional vaccine against the influenza virus at 2 times to 100 times the dosage level relative to the RNA vaccine.

In some embodiments, the immune response in the subject is equivalent to an immune response in a subject vaccinated with a traditional vaccine at 2, 3, 4, 5, 10, 50, 100 times the dosage level relative to the influenza vaccine.

In some embodiments the immune response in the subject is equivalent to an immune response in a subject vaccinated with a traditional vaccine at 10-100 times, or 100-1000 times, the dosage level relative to the influenza vaccine.

In some embodiments the immune response is assessed by determining [protein]antibody titer in the subject.

Some embodiments provide a method of inducing an immune response in a subject by administering to the subject an influenza RNA (e.g., mRNA) vaccine comprising at least one RNA (e.g., mRNA) polynucleotide having an open reading frame encoding at least one influenza antigenic polypeptide, thereby inducing in the subject an immune response specific to the antigenic polypeptide, wherein the immune response in the subject is induced 2 days to 10 weeks earlier relative to an immune response induced in a subject vaccinated with a prophylactically effective dose of a traditional vaccine against influenza. In some embodiments, the immune response in the subject is induced in a subject vaccinated with a prophylactically effective dose of a traditional vaccine at 2 times to 100 times the dosage level relative to the influenza RNA (e.g., mRNA) vaccine.

In some embodiments the immune response in the subject is equivalent to an immune response in a subject vaccinated with a traditional vaccine at 2, 3, 4, 5, 10, 50, 100 times the dosage level relative to the influenza RNA (e.g., mRNA) vaccine.

In some embodiments, the immune response in the subject is induced 2 days earlier, or 3 days earlier, relative to an immune response induced in a subject vaccinated with a prophylactically effective dose of a traditional vaccine.

In some embodiments the immune response in the subject is induced 1 week, 2 weeks, 3 weeks, 5 weeks, or 10 weeks earlier relative to an immune response induced in a subject vaccinated with a prophylactically effective dose of a traditional vaccine.

Therapeutic and Prophylactic Compositions

Provided herein are compositions (e.g., pharmaceutical compositions), methods, kits and reagents for prevention, treatment or diagnosis of influenza in humans and other mammals, for example. Influenza RNA (e.g. mRNA) vaccines can be used as therapeutic or prophylactic agents. They may be used in medicine to prevent and/or treat infectious disease. In some embodiments, the respiratory RNA (e.g., mRNA) vaccines of the present disclosure are used fin the priming of immune effector cells, for example, to activate peripheral blood mononuclear cells (PBMCs) ex vivo, which are then infused (re-infused) into a subject.

In some embodiments, influenza vaccine containing RNA (e.g., mRNA) polynucleotides as described herein can be administered to a subject (e.g., a mammalian subject, such as a human subject), and the RNA (e.g., mRNA) polynucleotides are translated in vivo to produce an antigenic polypeptide.

The influenza RNA (e.g., mRNA) vaccines may be induced for translation of a polypeptide (e.g., antigen or immunogen) in a cell, tissue or organism. In some embodiments, such translation occurs in vivo, although such translation may occur ex vivo, in culture or in vitro. In some embodiments, the cell, tissue or organism is contacted with an effective amount of a composition containing an influenza RNA (e.g., mRNA) vaccine that contains a polynucleotide that has at least one a translatable region encoding an antigenic polypeptide.

An "effective amount" of an influenza RNA (e.g. mRNA) vaccine is provided based, at least in part, on the target tissue, target cell type, means of administration, physical characteristics of the polynucleotide (e.g., size, and extent of modified nucleosides) and other components of the vaccine, and other determinants. In general, an effective amount of the influenza RNA (e.g., mRNA) vaccine composition provides an induced or boosted immune response as a function of antigen production in the cell, preferably more efficient than a composition containing a corresponding unmodified polynucleotide encoding the same antigen or a peptide antigen. Increased antigen production may be demonstrated by increased cell transfection (the percentage of cells transfected with the RNA, e.g., mRNA, vaccine), increased protein translation from the polynucleotide, decreased nucleic acid degradation (as demonstrated, for example, by increased duration of protein translation from a modified polynucleotide), or altered antigen specific immune response of the host cell.

In some embodiments, RNA (e.g. mRNA) vaccines (including polynucleotides their encoded polypeptides) in accordance with the present disclosure may be used for treatment of Influenza.

Influenza RNA (e.g. mRNA) vaccines may be administered prophylactically or therapeutically as part of an active immunization scheme to healthy individuals or early in infection during the incubation phase or during active infection after onset of symptoms. In some embodiments, the amount of RNA (e.g., mRNA) vaccine of the present disclosure provided to a cell, a tissue or a subject may be an amount effective for immune prophylaxis.

Influenza RNA (e.g. mRNA) vaccines may be administrated with other prophylactic or therapeutic compounds. As a non-limiting example, a prophylactic or therapeutic compound may be an adjuvant or a booster. As used herein, when referring to a prophylactic composition, such as a vaccine, the term "booster" refers to an extra administration of the prophylactic (vaccine) composition. A booster (or booster vaccine) may be given after an earlier administration of the prophylactic composition. The time of administration between the initial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 18 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years. In some embodiments, the time of administration between the initial administration of the prophylactic composition and the booster may be, but is not limited to, 1 week, 2 weeks, 3 weeks, 1 month, 2 months, 3 months, 6 months or 1 year.

In some embodiments, influenza RNA (e.g. mRNA) vaccines may be administered intramuscularly, intradermally, or intranasally, similarly to the administration of inactivated vaccines known in the art. In some embodiments, influenza RNA (e.g. mRNA) vaccines are administered intramuscularly.

Influenza RNA (e.g. mRNA) vaccines may be utilized in various settings depending on the prevalence of the infection or the degree or level of unmet medical need. As a non-limiting example, the RNA (e.g., mRNA) vaccines may be utilized to treat and/or prevent a variety of influenzas. RNA (e.g., mRNA) vaccines have superior properties in that they produce much larger antibody titers and produce responses early than commercially available anti-viral agents/compositions.

Provided herein are pharmaceutical compositions including influenza RNA (e.g. mRNA) vaccines and RNA (e.g. mRNA) vaccine compositions and/or complexes optionally in combination with one or more pharmaceutically acceptable excipients.

Influenza RNA (e.g. mRNA) vaccines may be formulated or administered alone or in conjunction with one or more other components. For instance, Influenza RNA (e.g., mRNA) vaccines (vaccine compositions) may comprise other components including, but not limited to, adjuvants.

In some embodiments, influenza (e.g. mRNA) vaccines do not include an adjuvant (they are adjuvant free).

Influenza RNA (e.g. mRNA) vaccines may be formulated or administered in combination with one or more pharmaceutically-acceptable excipients. In some embodiments, vaccine compositions comprise at least one additional active substances, such as, for example, a therapeutically-active substance, a prophylactically-active substance, or a combination of both. Vaccine compositions may be sterile, pyrogen-free or both sterile and pyrogen-free. General considerations in the formulation and/or manufacture of pharmaceutical agents, such as vaccine compositions, may be found, for example, in Remington: The Science and Practice of Pharmacy 21st ed., Lippincott Williams & Wilkins, 2005 (incorporated herein by reference in its entirety).

In some embodiments, influenza RNA (e.g. mRNA) vaccines are administered to humans, human patients or subjects. For the purposes of the present disclosure, the phrase "active ingredient" generally refers to the RNA (e.g., mRNA) vaccines or the polynucleotides contained therein, for example, RNA polynucleotides (e.g., mRNA polynucleotides) encoding antigenic polypeptides.

Formulations of the influenza vaccine compositions described herein may be prepared by any method known or hereafter developed in the art of pharmacology. In general, such preparatory methods include the step of bringing the active ingredient (e.g., mRNA polynucleotide) into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Influenza RNA (e.g. mRNA) vaccines can be formulated using one or more excipients to: increase stability; increase cell transfection; permit the sustained or delayed release (e.g., from a depot formulation); alter the biodistribution (e.g., target to specific tissues or cell types); increase the translation of encoded protein in vivo; and/or alter the release profile of encoded protein (antigen) in vivo. In addition to traditional excipients such as any and all solvents, dispersion media, diluents, or other liquid vehicles, dispersion or suspension aids, surface active agents, isotonic agents, thickening or emulsifying agents, preservatives, excipients can include, without limitation, lipidoids, liposomes, lipid nanoparticles, polymers, lipoplexes, core-shell nanoparticles, peptides, proteins, cells transfected with influenza RNA (e.g. mRNA)vaccines (e.g., for transplantation into a subject), hyaluronidase, nanoparticle mimics and combinations thereof.

Stabilizing Elements

Naturally-occurring eukaryotic mRNA molecules have been found to contain stabilizing elements, including, but not limited to untranslated regions (UTR) at their 5'-end (5'UTR) and/or at their 3'-end (3'UTR), in addition to other structural features, such as a 5'-cap structure or a 3'-poly(A) tail. Both the 5'UTR and the 3'UTR are typically transcribed from the genomic DNA and are elements of the premature mRNA. Characteristic structural features of mature mRNA, such as the 5'-cap and the 3'-poly(A) tail are usually added to the transcribed (premature) mRNA during mRNA processing. The 3'-poly(A) tail is typically a stretch of adenine nucleotides added to the 3'-end of the transcribed mRNA. It can comprise up to about 400 adenine nucleotides. In some embodiments the length of the 3'-poly(A) tail may be an essential element with respect to the stability of the individual mRNA.

In some embodiments the RNA (e.g., mRNA) vaccine may include one or more stabilizing elements. Stabilizing elements may include for instance a histone stem-loop. A stem-loop binding protein (SLBP), a 32 kDa protein has been identified. It is associated with the histone stem-loop at the 3-end of the histone messages in both the nucleus and the cytoplasm. Its expression level is regulated by the cell cycle; it is peaks during the S-phase, when histone mRNA levels are also elevated. The protein has been shown to be essential for efficient 3-end processing of histone pre-mRNA by the U7 snRNP. SLBP continues to be associated with the stem-loop after processing, and then stimulates the translation of mature histone mRNAs into histone proteins in the cytoplasm. The RNA binding domain of SLBP is conserved through metazoa and protozoa; its binding to the histone stem-loop depends on the structure of the loop. The minimum binding site includes at least three nucleotides 5' and two nucleotides 3' relative to the stem-loop.

In some embodiments, the RNA (e.g., mRNA) vaccines include a coding region, at least one histone stem-loop, and optionally, a poly(A) sequence or polyadenylation signal. The poly(A) sequence or polyadenylation signal generally should enhance the expression level of the encoded protein. The encoded protein, in some embodiments, is not a histone protein, a reporter protein (e.g. Luciferase, GFP, EGFP, β-Galactosidase, EGFP), or a marker or selection protein (e.g. alpha-Globin, Galactokinase and Xanthine:guanine phosphoribosyl transferase (GPT)).

In some embodiments, the combination of a poly(A) sequence or polyadenylation signal and at least one histone stem-loop, even though both represent alternative mechanisms in nature, acts synergistically to increase the protein expression beyond the level observed with either of the individual elements. It has been found that the synergistic effect of the combination of poly(A) and at least one histone stem-loop does not depend on the order of the elements or the length of the poly(A) sequence.

In some embodiments, the RNA (e.g., mRNA) vaccine does not comprise a histone downstream element (HDE). "Histone downstream element" (HDE) includes a purine-rich polynucleotide stretch of approximately 15 to 20 nucleotides 3' of naturally occurring stem-loops, representing the binding site for the U7 snRNA, which is involved in processing of histone pre-mRNA into mature histone mRNA. Ideally, the inventive nucleic acid does not include an intron.

In some embodiments, the RNA (e.g., mRNA) vaccine may or may not contain a enhancer and/or promoter sequence, which may be modified or unmodified or which may be activated or inactivated. In some embodiments, the histone stem-loop is generally derived from histone genes, and includes an intramolecular base pairing of two neighbored partially or entirely reverse complementary sequences separated by a spacer, including (e.g., consisting of) a short sequence, which forms the loop of the structure. The unpaired loop region is typically unable to base pair with either of the stem loop elements. It occurs more often in RNA, as is a key component of many RNA secondary structures, but may be present in single-stranded DNA as well. Stability of the stem-loop structure generally depends on the length, number of mismatches or bulges, and base composition of the paired region. In some embodiments, wobble base pairing (non-Watson-Crick base pairing) may result. In some embodiments, the at least one histone stem-loop sequence comprises a length of 15 to 45 nucleotides.

In other embodiments the RNA (e.g., mRNA) vaccine may have one or more AU-rich sequences removed. These sequences, sometimes referred to as AURES are destabilizing sequences found in the 3'UTR. The AURES may be removed from the RNA (e.g., mRNA) vaccines. Alternatively the AURES may remain in the RNA (e.g., mRNA) vaccine.

Nanoparticle Formulations

In some embodiments, influenza RNA (e.g. mRNA) vaccines are formulated in a nanoparticle. In some embodiments, influenza RNA (e.g. mRNA) vaccines are formulated in a lipid nanoparticle. In some embodiments, influenza RNA (e.g. mRNA) vaccines are formulated in a lipid-polycation complex, referred to as a cationic lipid nanoparticle. As a non-limiting example, the polycation may include a cationic peptide or a polypeptide such as, but not limited to, polylysine, polyornithine and/or polyarginine. In some embodiments, influenza RNA (e.g., mRNA) vaccines are formulated in a lipid nanoparticle that includes a non-cationic lipid such as, but not limited to, cholesterol or dioleoyl phosphatidylethanolamine (DOPE).

A lipid nanoparticle formulation may be influenced by, but not limited to, the selection of the cationic lipid component, the degree of cationic lipid saturation, the nature of the PEGylation, ratio of all components and biophysical parameters such as size. In one example by Semple et al. (*Nature Biotech.* 2010 28:172-176), the lipid nanoparticle formulation is composed of 57.1% cationic lipid, 7.1% dipalmitoylphosphatidylcholine, 34.3% cholesterol, and 1.4% PEG-c-DMA. As another example, changing the composition of the cationic lipid can more effectively deliver siRNA to various antigen presenting cells (Basha et al. *Mol Ther.* 2011 19:2186-2200).

In some embodiments, lipid nanoparticle formulations may comprise 35 to 45% cationic lipid, 40% to 50% cationic lipid, 50% to 60% cationic lipid and/or 55% to 65% cationic lipid. In some embodiments, the ratio of lipid to RNA (e.g., mRNA) in lipid nanoparticles may be 5:1 to 20:1, 10:1 to 25:1, 15:1 to 30:1 and/or at least 30:1.

In some embodiments, the ratio of PEG in the lipid nanoparticle formulations may be increased or decreased and/or the carbon chain length of the PEG lipid may be modified from C14 to C18 to alter the pharmacokinetics and/or biodistribution of the lipid nanoparticle formulations. As a non-limiting example, lipid nanoparticle formulations may contain 0.5% to 3.0%, 1.0% to 3.5%, 1.5% to 4.0%, 2.0% to 4.5%, 2.5% to 5.0% and/or 3.0% to 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, an influenza RNA (e.g. mRNA) vaccine formulation is a nanoparticle that comprises at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In some embodiments, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US2013/0150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US2013/0150625); 2-amino-3-[(9Z)-octadec-9-en-1-yloxy]-2-{[(9Z)-octadec-9-en-1-yloxy]methyl}propan-1-ol (Compound 2 in US2013/0150625); 2-amino-3-[(9Z,12Z)-octadeca-9,12-dien-1-yloxy]-2-[(octyloxy)methyl]propan-1-ol (Compound 3 in US2013/0150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US2013/0150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate, and further comprise a neutral lipid, a sterol and a molecule capable of reducing particle aggregation, for example a PEG or PEG-modified lipid.

In some embodiments, a lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy) heptadecanedioate; (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of 20-60% cationic lipid:5-25% neutral lipid: 25-55% sterol; 0.5-15% PEG-lipid.

In some embodiments, a lipid nanoparticle formulation includes 25% to 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, e.g., 35 to 65%, 45 to 65%, 60%, 57.5%, 50% or 40% on a molar basis.

In some embodiments, a lipid nanoparticle formulation includes 0.5% to 15% on a molar basis of the neutral lipid, e.g., 3 to 12%, 5 to 10% or 15%, 10%, or 7.5% on a molar basis. Examples of neutral lipids include, without limitation, DSPC, POPC, DPPC, DOPE and SM. In some embodiments, the formulation includes 5% to 50% on a molar basis of the sterol (e.g., 15 to 45%, 20 to 40%, 40%, 38.5%, 35%, or 31% on a molar basis. A non-limiting example of a sterol is cholesterol. In some embodiments, a lipid nanoparticle formulation includes 0.5% to 20% on a molar basis of the PEG or PEG-modified lipid (e.g., 0.5 to 10%, 0.5 to 5%, 1.5%, 0.5%, 1.5%, 3.5%, or 5% on a molar basis. In some embodiments, a PEG or PEG modified lipid comprises a PEG molecule of an average molecular weight of 2,000 Da. In some embodiments, a PEG or PEG modified lipid comprises a PEG molecule of an average molecular weight of less than 2,000, for example around 1,500 Da, around 1,000 Da, or around 500 Da. Non-limiting examples of PEG-modified lipids include PEG-distearoyl glycerol (PEG-DMG) (also referred herein as PEG-C14 or C14-PEG), PEG-cDMA (further discussed in Reyes et al. J. Controlled Release, 107, 276-287 (2005) the contents of which are herein incorporated by reference in their entirety).

In some embodiments, lipid nanoparticle formulations include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 0.5-15% of the neutral lipid, 5-50% of the sterol, and 0.5-20% of the PEG or PEG-modified lipid on a molar basis.

In some embodiments, lipid nanoparticle formulations include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 3-12% of the neutral lipid, 15-45% of the sterol, and 0.5-10% of the PEG or PEG-modified lipid on a molar basis.

In some embodiments, lipid nanoparticle formulations include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 5-10% of the neutral lipid, 25-40% of the sterol, and 0.5-10% of the PEG or PEG-modified lipid on a molar basis.

In some embodiments, lipid nanoparticle formulations include 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 7.5% of the neutral lipid, 31% of the sterol, and 1.5% of the PEG or PEG-modified lipid on a molar basis.

In some embodiments, lipid nanoparticle formulations include 50% of a cationic lipid selected from 2,2-dilinoleyl- 4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 10% of the neutral lipid, 38.5% of the sterol, and 1.5% of the PEG or PEG-modified lipid on a molar basis.

In some embodiments, lipid nanoparticle formulations include 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 10% of the neutral lipid, 35% of the sterol, 4.5% or 5% of the PEG or PEG-modified lipid, and 0.5% of the targeting lipid on a molar basis.

In some embodiments, lipid nanoparticle formulations include 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 15% of the neutral lipid, 40% of the sterol, and 5% of the PEG or PEG-modified lipid on a molar basis.

In some embodiments, lipid nanoparticle formulations include 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 7.1% of the neutral lipid, 34.3% of the sterol, and 1.4% of the PEG or PEG-modified lipid on a molar basis.

In some embodiments, lipid nanoparticle formulations include 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in their entirety), 7.5% of the neutral lipid, 31.5% of the sterol, and 3.5% of the PEG or PEG-modified lipid on a molar basis.

In some embodiments, lipid nanoparticle formulations consists essentially of a lipid mixture in molar ratios of 20-70% cationic lipid:5-45% neutral lipid:20-55% cholesterol:0.5-15% PEG-modified lipid. In some embodiments, lipid nanoparticle formulations consists essentially of a lipid mixture in a molar ratio of 20-60% cationic lipid:5-25% neutral lipid:25-55% cholesterol:0.5-15% PEG-modified lipid.

In some embodiments, the molar lipid ratio is 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Non-limiting examples of lipid nanoparticle compositions and methods of making them are described, for example, in Semple et al. (2010) *Nat. Biotechnol.* 28:172-176; Jayarama et al. (2012), *Angew. Chem. Int. Ed.*, 51: 8529-8533; and Maier et al. (2013) *Molecular Therapy* 21, 1570-1578 (the contents of each of which are incorporated herein by reference in their entirety).

In some embodiments, lipid nanoparticle formulations may comprise a cationic lipid, a PEG lipid and a structural lipid and optionally comprise a non-cationic lipid. As a non-limiting example, a lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, a lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and di((Z)-non-2-en-1-yl) 9-((4-(dimethylamino)butanoyl)oxy) heptadecanedioate.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise 40-60% of cationic lipid, 5-15% of a non-cationic lipid, 1-2% of a PEG lipid and 30-50% of a structural lipid. As another non-limiting example, the lipid nanoparticle may comprise 50% cationic lipid, 10% non-cationic lipid, 1.5% PEG lipid and 38.5% structural lipid. As yet another non-limiting example, the lipid nanoparticle may comprise 55% cationic lipid, 10% non-cationic lipid, 2.5% PEG lipid and 32.5% structural lipid. In some embodiments, the cationic lipid may be any cationic lipid described herein such as, but not limited to, DLin-KC2-DMA, DLin-MC3-DMA and di((Z)-non-2-en-1-yl) 9-((4-(dimethylamino)butanoyl)oxy) heptadecanedioate.

In some embodiments, the lipid nanoparticle formulations described herein may comprise a cationic lipid, a non-cationic lipid, a PEG lipid and a structural lipid. As a non-limiting example, the lipid nanoparticle comprise 50% of the cationic lipid DLin-KC2-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid DLin-MC3-DMA, 10% of the non-cationic lipid DSPC, 1.5% of the PEG lipid PEG-DOMG and 38.5% of the structural lipid cholesterol. As a non-limiting example, the lipid nanoparticle comprise 50% of the cationic lipid DLin-MC3-DMA, 10% of the non-cationic lipid DSPC, 1.5% of the PEG lipid PEG-DMG and 38.5% of the structural lipid cholesterol. As yet another non-limiting example, the lipid nanoparticle comprise 55% of the cationic lipid di((Z)-non-2-en-1-yl) 9-((4-(dimethylamino)butanoyl)oxy)heptadecanedioate, 10% of the non-cationic lipid DSPC, 2.5% of the PEG lipid PEG-DMG and 32.5% of the structural lipid cholesterol.

Relative amounts of the active ingredient, the pharmaceutically acceptable excipient, and/or any additional ingredients in a vaccine composition may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the influenza RNA (e.g. mRNA) vaccine composition may comprise the polynucleotide described herein, formulated in a lipid nanoparticle comprising MC3, Cholesterol, DSPC and PEG2000-DMG, the buffer trisodium citrate, sucrose and water for injection. As a non-limiting example, the composition comprises: 2.0 mg/mL of drug substance, 21.8 mg/mL of MC3, 10.1 mg/mL of cholesterol, 5.4 mg/mL of DSPC, 2.7 mg/mL of PEG2000-DMG, 5.16 mg/mL of trisodium citrate, 71 mg/mL of sucrose and 1.0 mL of water for injection.

In some embodiments, a nanoparticle (e.g., a lipid nanoparticle) has a mean diameter of 10-500 nm, 20-400 nm, 30-300 nm, 40-200 nm. In some embodiments, a nanoparticle (e.g., a lipid nanoparticle) has a mean diameter of 50-150 nm, 50-200 nm, 80-100 nm or 80-200 nm.

Liposomes, Lipoplexes, and Lipid Nanoparticles

The RNA (e.g., mRNA) vaccines of the disclosure can be formulated using one or more liposomes, lipoplexes, or lipid nanoparticles. In some embodiments, pharmaceutical compositions of RNA (e.g., mRNA) vaccines include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In some embodiments, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In some embodiments, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In some embodiments, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In some embodiments, the RNA (e.g., mRNA) vaccine pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In some embodiments, the cationic lipid may be a low molecular weight cationic lipid such as those described in U.S. Patent Application No. 2013/0090372, the contents of which are herein incorporated by reference in their entirety.

In some embodiments, the RNA (e.g., mRNA) vaccines may be formulated in a lipid vesicle, which may have crosslinks between functionalized lipid bilayers.

In some embodiments, the RNA (e.g., mRNA) vaccines may be formulated in a lipid-polycation complex. The formation of the lipid-polycation complex may be accomplished by methods known in the art and/or as described in U.S. Pub. No. 2012/0178702, herein incorporated by reference in its entirety. As a non-limiting example, the polycation may include a cationic peptide or a polypeptide such as, but not limited to, polylysine, polyornithine and/or polyarginine. In some embodiments, the RNA (e.g., mRNA) vaccines may be formulated in a lipid-polycation complex, which may further include a non-cationic lipid such as, but not limited to, cholesterol or dioleoyl phosphatidylethanolamine (DOPE).

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(ω-methoxy-poly(ethyleneglycol) 2000)carbamoyl)]-1,2-dimyristyloxypropyl-3-amine) (also referred to herein as PEG-DOMG) as compared to the cationic lipid, DSPC and cholesterol. In some embodiments, the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In some embodiments, the RNA (e.g., mRNA) vaccines may be formulated in a lipid nanoparticle.

In some embodiments, the RNA (e.g., mRNA) vaccine formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US2013/0150625); 2-amino-3-[(9Z)-octadec-9-en-1-yloxy]-2-{[(9Z)-octadec-9-en-1-yloxy] methyl}propan-1-ol (Compound 2 in US2013/0150625); 2-amino-3-[(9Z,12Z)-octadeca-9,12-dien-1-yloxy]-2-[(octyloxy)methyl]propan-1-ol (Compound 3 in US2013/0150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US2013/0150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate, and further comprise a neutral lipid, a sterol and a molecule capable of reducing particle aggregation, for example a PEG or PEG-modified lipid.

In some embodiments, the lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy) heptadecanedioate; (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In some embodiments, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, e.g., from about 35 to about 65%, from about 45 to about 65%, about 60%, about 57.5%, about 50% or about 40% on a molar basis.

In some embodiments, the formulation includes from about 0.5% to about 15% on a molar basis of the neutral lipid e.g., from about 3 to about 12%, from about 5 to about 10% or about 15%, about 10%, or about 7.5% on a molar basis. Examples of neutral lipids include, but are not limited to, DSPC, POPC, DPPC, DOPE and SM. In some embodiments, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In some embodiments, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis. In some embodiments, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Examples of PEG-modified lipids include, but are not limited to, PEG-distearoyl glycerol (PEG-DMG) (also referred herein as PEG-C14 or C14-PEG), PEG-cDMA (further discussed in Reyes et al. *J. Controlled Release*, 107, 276-287 (2005) the contents of which are herein incorporated by reference in their entirety).

In some embodiments, the formulations of the present disclosure include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 0.5-15% of the neutral lipid, 5-50% of the sterol, and 0.5-20% of the PEG or PEG-modified lipid on a molar basis.

In some embodiments, the formulations of the present disclosure include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 3-12% of the neutral lipid, 15-45% of the sterol, and 0.5-10% of the PEG or PEG-modified lipid on a molar basis.

In some embodiments, the formulations of the present disclosure include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, 5-10% of the neutral lipid, 25-40% of the sterol, and 0.5-10% of the PEG or PEG-modified lipid on a molar basis.

In some embodiments, the formulations of the present disclosure include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, about 7.5% of the neutral lipid, about 31% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, about 10% of the neutral lipid, about 38.5% of the sterol, and about 1.5% of the PEG or PEG-modified lipid on a molar basis.

In some embodiments, the formulations of the present disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, about 10% of the neutral lipid, about 35% of the sterol, about 4.5% or about 5% of the PEG or PEG-modified lipid, and about 0.5% of the targeting lipid on a molar basis.

In some embodiments, the formulations of the present disclosure include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, about 15% of the neutral lipid, about 40% of the sterol, and about 5% of the PEG or PEG-modified lipid on a molar basis.

In some embodiments, the formulations of the present disclosure include about 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate, about 7.1% of the neutral lipid, about 34.3% of the sterol, and about 1.4% of the PEG or PEG-modified lipid on a molar basis.

In some embodiments, the formulations of the present disclosure include about 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in their entirety), about 7.5% of the neutral lipid, about 31.5% of the sterol, and about 3.5% of the PEG or PEG-modified lipid on a molar basis.

In some embodiments, lipid nanoparticle formulation consists essentially of a lipid mixture in molar ratios of about 20-70% cationic lipid:5-45% neutral lipid:20-55% cholesterol:0.5-15% PEG-modified lipid; more preferably in a molar ratio of about 20-60% cationic lipid:5-25% neutral lipid:25-55% cholesterol:0.5-15% PEG-modified lipid.

In some embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Examples of lipid nanoparticle compositions and methods of making same are described, for example, in Semple et al. (2010) *Nat. Biotechnol.* 28:172-176; Jayarama et al. (2012), *Angew. Chem. Int. Ed.,* 51: 8529-8533; and Maier et al. (2013) *Molecular Therapy* 21, 1570-1578 (the contents of each of which are incorporated herein by reference in their entirety).

In some embodiments, the lipid nanoparticle formulations described herein may comprise a cationic lipid, a PEG lipid and a structural lipid and optionally comprise a non-cationic lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In some embodiments, the cationic lipid may be any cationic lipid described herein such as, but not limited to, DLin-KC2-DMA, DLin-MC3-DMA and di((Z)-non-2-en-1-yl) 9-((4-(dimethylamino)butanoyl)oxy)heptadecanedioate.

In some embodiments, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In some embodiments, the cationic lipid may be any cationic lipid described herein such as, but not limited to, DLin-KC2-DMA, DLin-MC3-DMA and di((Z)-non-2-en-1-yl) 9-((4-(dimethylamino)butanoyl)oxy)heptadecanedioate.

In some embodiments, the lipid nanoparticle formulations described herein may comprise a cationic lipid, a non-cationic lipid, a PEG lipid and a structural lipid. As a non-limiting example, the lipid nanoparticle comprise about 50% of the cationic lipid DLin-KC2-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DMG and about 38.5% of the structural lipid cholesterol. As yet another non-limiting example, the lipid nanoparticle comprise about 55% of the cationic lipid di((Z)-non-2-en-1-yl) 9-((4-(dimethylamino) butanoyl)oxy)heptadecanedioate, about 10% of the non-cationic lipid DSPC, about 2.5% of the PEG lipid PEG-DMG and about 32.5% of the structural lipid cholesterol.

As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16, 19-dien-8-amine, (13Z,16Z)—N,N-dimethyldocosa-13,16-dien-5-amine, (12Z,15Z)—N,N-dimethylhenicosa-12,15- dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl] pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl] eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine, N,N-dimethyl-1-[(1S,2S)-2-{[(1R,2R)-2-pentylcyclopropyl] methyl}cyclopropyl]nonadecan-10-amine, N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl] heptyl} dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy) propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl] ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy) propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy) propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentyl-cyclopropyl]methyl}cyclopropyl]octyl}oxy)propan-2-amine, N,N-dimethyl-1-{[8-(2-oc1ylcyclopropyl)octyl] oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In some embodiments, the LNP formulations of the RNA (e.g., mRNA) vaccines may contain PEG-c-DOMG at 3% lipid molar ratio. In some embodiments, the LNP formulations of the RNA (e.g., mRNA) vaccines may contain PEG-c-DOMG at 1.5% lipid molar ratio.

In some embodiments, the pharmaceutical compositions of the RNA (e.g., mRNA) vaccines may include at least one of the PEGylated lipids described in International Publication No. WO2012/099755, the contents of which are herein incorporated by reference in their entirety.

In some embodiments, the LNP formulation may contain PEG-DMG 2000 (1,2-dimyristoyl-sn-glycero-3-phopho-ethanolamine-N-[methoxy(polyethylene glycol)-2000). In some embodiments, the LNP formulation may contain PEG-DMG 2000, a cationic lipid known in the art and at least one other component. In some embodiments, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA (e.g., mRNA) vaccines, PNAS 2012; PMID: 22908294, the contents of each of which are herein incorporated by reference in their entirety).

The lipid nanoparticles described herein may be made in a sterile environment.

In some embodiments, the LNP formulation may be formulated in a nanoparticle such as a nucleic acid-lipid particle. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle.

The nanoparticle formulations may comprise a phosphate conjugate. The phosphate conjugate may increase in vivo circulation times and/or increase the targeted delivery of the nanoparticle. As a non-limiting example, the phosphate conjugates may include a compound of any one of the formulas described in International Application No. WO2013/033438, the contents of which are herein incorporated by reference in its entirety.

The nanoparticle formulation may comprise a polymer conjugate. The polymer conjugate may be a water soluble conjugate. The polymer conjugate may have a structure as described in U.S. Patent Application No. 2013/0059360, the contents of which are herein incorporated by reference in its entirety. In some embodiments, polymer conjugates with the polynucleotides of the present disclosure may be made using the methods and/or segmented polymeric reagents described in U.S. Patent Application No. 2013/0072709, the contents of which are herein incorporated by reference in its entirety. In some embodiments, the polymer conjugate may have pendant side groups comprising ring moieties such as, but not limited to, the polymer conjugates described in U.S. Patent Publication No. US2013/0196948, the contents which are herein incorporated by reference in its entirety.

The nanoparticle formulations may comprise a conjugate to enhance the delivery of nanoparticles of the present disclosure in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al. (Science 2013 339, 971-975), herein incorporated by reference in its entirety). As shown by Rodriguez et al., the self peptides delayed macrophage-mediated clearance of nanoparticles which enhanced delivery of the nanoparticles. In another aspect, the conjugate may be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In some embodiments, the RNA (e.g., mRNA) vaccines of the present disclosure are formulated in nanoparticles which comprise a conjugate to enhance the delivery of the nanoparticles of the present disclosure in a subject. The conjugate may be the CD47 membrane or the conjugate may be derived from the CD47 membrane protein, such as the "self" peptide described previously. In some embodiments, the nanoparticle may comprise PEG and a conjugate of CD47 or a derivative thereof. In some embodiments, the nanoparticle may comprise both the "self" peptide described above and the membrane protein CD47.

In some embodiments, a "self" peptide and/or CD47 protein may be conjugated to a virus-like particle or pseudovirion, as described herein for delivery of the RNA (e.g., mRNA) vaccines of the present disclosure.

In some embodiments, RNA (e.g., mRNA) vaccine pharmaceutical compositions comprising the polynucleotides of the present disclosure and a conjugate that may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in U.S. Patent Publication No. US2013/0184443, the contents of which are herein incorporated by reference in their entirety.

The nanoparticle formulations may be a carbohydrate nanoparticle comprising a carbohydrate carrier and a RNA (e.g., mRNA) vaccine. As a non-limiting example, the carbohydrate carrier may include, but is not limited to, an anhydride-modified phytoglycogen or glycogen-type material, phytoglycogen octenyl succinate, phytoglycogen beta-dextrin, anhydride-modified phytoglycogen beta-dextrin. (See e.g., International Publication No. WO2012/109121; the contents of which are herein incorporated by reference in their entirety).

Nanoparticle formulations of the present disclosure may be coated with a surfactant or polymer in order to improve the delivery of the particle. In some embodiments, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, RNA (e.g., mRNA) vaccines within the central nervous system. As a non-limiting example nanoparticles comprising a hydrophilic coating and methods of making such nanoparticles are described in U.S. Patent Publication No. US2013/0183244, the contents of which are herein incorporated by reference in their entirety.

In some embodiments, the lipid nanoparticles of the present disclosure may be hydrophilic polymer particles. Non-limiting examples of hydrophilic polymer particles and methods of making hydrophilic polymer particles are described in U.S. Patent Publication No. US2013/0210991, the contents of which are herein incorporated by reference in their entirety.

In some embodiments, the lipid nanoparticles of the present disclosure may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In some embodiments, the internal ester linkage may be located on either side of the saturated carbon.

In some embodiments, an immune response may be elicited by delivering a lipid nanoparticle which may include a nanospecies, a polymer and an immunogen. (U.S. Publication No. 2012/0189700 and International Publication No. WO2012/099805; each of which is herein incorporated by reference in their entirety). The polymer may encapsulate the nanospecies or partially encapsulate the nanospecies. The immunogen may be a recombinant protein, a modified RNA and/or a polynucleotide described herein. In some embodiments, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosa tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104:1482-487; Lai et al. *Adv Drug Deliv Rev.* 2009 61: 158-171; each of which is herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670 or International Patent Publication No. WO2013/110028, the contents of each of which are herein incorporated by reference in its entirety.

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. Non-limiting examples of biocompatible polymers are described in International Patent Publication No. WO2013/116804, the contents of which are herein incorporated by reference in their entirety. The polymeric material may additionally be irradiated. As a non-limiting example, the polymeric material may be gamma irradiated (see e.g., International App. No. WO2012/082165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly (lactic acid-co-glycolic acid) (PLGA), poly(L-lactic acid-co-glycolic acid) (PLLGA), poly(D,L-lactide) (PDLA), poly (L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth) acrylate), poly(butyl(meth)acrylate), poly(isobutyl(meth) acrylate), poly(hexyl(meth)acrylate), poly(isodecyl(meth) acrylate), poly(lauryl(meth)acrylate), poly(phenyl(meth) acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), PEG-PLGA-PEG and trimethylene carbonate, polyvinylpyrrolidone. The lipid nanoparticle may be coated or associated with a co-polymer such as, but not limited to, a block co-polymer (such as a branched polyether-polyamide block copolymer described in International Publication No. WO2013/012476, herein incorporated by reference in its entirety), and (poly(ethylene glycol))-(poly(propylene oxide))-(poly(ethylene glycol)) triblock copolymer (see e.g., U.S. Publication 2012/0121718 and U.S. Publication 2010/0003337 and U.S. Pat. No. 8,263,665, the contents of each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; the contents of which are herein incorporated by reference in their entirety). A non-limiting scalable method to produce nanoparticles which can penetrate human mucus is described by Xu et al. (see, e.g., J Control Release 2013, 170:279-86; the contents of which are herein incorporated by reference in their entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see e.g., U.S. Publication 2010/0215580 and U.S. Publication 2008/0166414 and US2013/0164343; the contents of each of which are herein incorporated by reference in their entirety).

In some embodiments, the mucus penetrating lipid nanoparticles may comprise at least one polynucleotide described herein. The polynucleotide may be encapsulated in the lipid nanoparticle and/or disposed on the surface of the particle. The polynucleotide may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion, which may increase the delivery of the mucus penetrating lipid nanoparticles to the mucosal tissue.

In some embodiments, the mucus penetrating lipid nanoparticles may be a hypotonic formulation comprising a mucosal penetration enhancing coating. The formulation may be hypotonic for the epithelium to which it is being delivered. Non-limiting examples of hypotonic formulations may be found in International Patent Publication No. WO2013/110028, the contents of which are herein incorporated by reference in their entirety.

In some embodiments, in order to enhance the delivery through the mucosal barrier the RNA (e.g., mRNA) vaccine formulation may comprise or be a hypotonic solution. Hypotonic solutions were found to increase the rate at which mucoinert particles such as, but not limited to, mucus-penetrating particles, were able to reach the vaginal epithelial surface (see e.g., Ensign et al. Biomaterials 2013 34(28): 6922-9, the contents of which are herein incorporated by reference in their entirety).

In some embodiments, the RNA (e.g., mRNA) vaccine is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132, the contents of each of which are incorporated herein by reference in their entirety).

In some embodiments, such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319:627-630; Peer and Lieberman, Gene Ther. 2011 18:1127-1133, the contents of each of which are incorporated herein by reference in their entirety). One example of passive targeting of formulations to liver cells includes the DLin-DMA, DLin-KC2-DMA and DLin-MC3-DMA-based lipid nanoparticle formulations, which have been shown to bind to apolipoprotein E and promote binding and uptake of these formulations into hepatocytes in vivo (Akinc et al. Mol Ther. 2010 18:1357-1364, the contents of which are herein incorporated by reference in their entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133, the contents of each of which are incorporated herein by reference in their entirety).

In some embodiments, the RNA (e.g., mRNA) vaccine is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In some embodiments, the lipid nanoparticle may be a self-assembly lipid-polymer nanoparticle (see Zhang et al., ACS Nano, 2008, 2, pp 1696-1702; the contents of which are herein incorporated by reference in their entirety). As a non-limiting example, the SLN may be the SLN described in International Patent Publication No. WO2013/105101, the contents of which are herein incorporated by reference in their entirety. As another non-limiting example, the SLN may be made by the methods or processes described in International Patent Publication No. WO2013/105101, the contents of which are herein incorporated by reference in their entirety.

Liposomes, lipoplexes, or lipid nanoparticles may be used to improve the efficacy of polynucleotides directed protein production as these formulations may be able to increase cell transfection by the RNA (e.g., mRNA) vaccine; and/or increase the translation of encoded protein. One such example involves the use of lipid encapsulation to enable the effective systemic delivery of polyplex plasmid DNA (Heyes et al., Mol Ther. 2007 15:713-720; the contents of which are incorporated herein by reference in their entirety). The liposomes, lipoplexes, or lipid nanoparticles may also be used to increase the stability of the polynucleotide.

In some embodiments, the RNA (e.g., mRNA) vaccines of the present disclosure can be formulated for controlled release and/or targeted delivery. As used herein, "controlled release" refers to a pharmaceutical composition or compound release profile that conforms to a particular pattern of release to effect a therapeutic outcome. In some embodiments, the RNA (e.g., mRNA) vaccines may be encapsulated into a delivery agent described herein and/or known in the art for controlled release and/or targeted delivery. As used herein, the term "encapsulate" means to enclose, surround or encase. As it relates to the formulation of the compounds of the disclosure, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the disclosure may be enclosed, surrounded or encased within the delivery agent. "Partially encapsulation" means that less than 10, 10, 20, 30, 40 50 or less of the pharmaceutical composition or compound of the disclosure may be enclosed, surrounded or encased within the delivery agent. Advantageously, encapsulation may be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the disclosure are encapsulated in the delivery agent.

In some embodiments, the controlled release formulation may include, but is not limited to, tri-block co-polymers. As a non-limiting example, the formulation may include two different types of tri-block co-polymers (International Pub.

No. WO2012/131104 and WO2012/131106, the contents of each of which are incorporated herein by reference in their entirety).

In some embodiments, the RNA (e.g., mRNA) vaccines may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc. Deerfield, Ill.), PEG-based sealants, and COSEAL® (Baxter International, Inc Deerfield, Ill.).

In some embodiments, the lipid nanoparticle may be encapsulated into any polymer known in the art which may form a gel when injected into a subject. As another non-limiting example, the lipid nanoparticle may be encapsulated into a polymer matrix which may be biodegradable.

In some embodiments, the RNA (e.g., mRNA) vaccine formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In some embodiments, the RNA (e.g., mRNA) vaccine controlled release and/or targeted delivery formulation may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the RNA (e.g., mRNA) vaccine controlled release and/or targeted delivery formulation comprising at least one polynucleotide may comprise at least one PEG and/or PEG related polymer derivatives as described in U.S. Pat. No. 8,404,222, the contents of which are incorporated herein by reference in their entirety.

In some embodiments, the RNA (e.g., mRNA) vaccine controlled release delivery formulation comprising at least one polynucleotide may be the controlled release polymer system described in US2013/0130348, the contents of which are incorporated herein by reference in their entirety.

In some embodiments, the RNA (e.g., mRNA) vaccines of the present disclosure may be encapsulated in a therapeutic nanoparticle, referred to herein as "therapeutic nanoparticle RNA (e.g., mRNA) vaccines." Therapeutic nanoparticles may be formulated by methods described herein and known in the art such as, but not limited to, International Pub Nos. WO2010/005740, WO2010/030763, WO2010/005721, WO2010/005723, WO2012/054923, U.S. Publication Nos. US2011/0262491, US2010/0104645, US2010/0087337, US2010/0068285, US2011/0274759, US2010/0068286, US2012/0288541, US2013/0123351 and US2013/0230567 and U.S. Pat. Nos. 8,206,747, 8,293,276, 8,318,208 and 8,318,211; the contents of each of which are herein incorporated by reference in their entirety. In some embodiments, therapeutic polymer nanoparticles may be identified by the methods described in US Pub No. US2012/0140790, the contents of which are herein incorporated by reference in their entirety.

In some embodiments, the therapeutic nanoparticle RNA (e.g., mRNA) vaccine may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides of the present disclosure (see International Pub No. WO2010/075072 and US Pub No. US2010/0216804, US2011/0217377 and US2012/0201859, the contents of each of which are incorporated herein by reference in their entirety). In another non-limiting example, the sustained release formulation may comprise agents which permit persistent bioavailability such as, but not limited to, crystals, macromolecular gels and/or particulate suspensions (see U.S. Patent Publication No US2013/0150295, the contents of each of which are incorporated herein by reference in their entirety).

In some embodiments, the therapeutic nanoparticle RNA (e.g., mRNA) vaccines may be formulated to be target specific. As a non-limiting example, the therapeutic nanoparticles may include a corticosteroid (see International Pub. No. WO2011/084518, the contents of which are incorporated herein by reference in their entirety). As a non-limiting example, the therapeutic nanoparticles may be formulated in nanoparticles described in International Pub No. WO2008/121949, WO2010/005726, WO2010/005725, WO2011/084521 and US Pub No. US2010/0069426, US2012/0004293 and US2010/0104655, the contents of each of which are incorporated herein by reference in their entirety.

In some embodiments, the nanoparticles of the present disclosure may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In some embodiments, the therapeutic nanoparticle comprises a diblock copolymer. In some embodiments, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof. In yet another embodiment, the diblock copolymer may be a high-X diblock copolymer such as those described in International Patent Publication No. WO2013/120052, the contents of which are incorporated herein by reference in their entirety.

As a non-limiting example the therapeutic nanoparticle comprises a PLGA-PEG block copolymer (see U.S. Publication No. US2012/0004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012/166923, the contents of each of which are herein incorporated by reference in their entirety). In yet another non-limiting example, the therapeutic nanoparticle is a stealth nanoparticle or a target-specific stealth nanoparticle as described in U.S. Patent Publication No. US2013/0172406, the contents of which are herein incorporated by reference in their entirety.

In some embodiments, the therapeutic nanoparticle may comprise a multiblock copolymer (see e.g., U.S. Pat. Nos. 8,263,665 and 8,287,910 and U.S. Patent Pub. No. US2013/0195987, the contents of each of which are herein incorporated by reference in their entirety).

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a TGF-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20:884-888; and Chang et al., Non-ionic amphiphilic biodegradable PEG-PLGA-PEG copolymer enhances gene delivery efficiency in rat skeletal muscle. J Controlled Release. 2007 118:245-253, the contents of each of which are herein incorporated by reference in their entirety). The RNA (e.g., mRNA) vaccines of the present disclosure may be formulated in lipid nanoparticles comprising the PEG-PLGA-PEG block copolymer.

In some embodiments, the therapeutic nanoparticle may comprise a multiblock copolymer (see e.g., U.S. Pat. Nos. 8,263,665 and 8,287,910 and U.S. Patent Pub. No. US2013/0195987, the contents of each of which are herein incorporated by reference in their entirety).

In some embodiments, the block copolymers described herein may be included in a polyion complex comprising a non-polymeric micelle and the block copolymer. (see e.g., U.S. Publication No. 2012/0076836, the contents of which are herein incorporated by reference in their entirety).

In some embodiments, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In some embodiments, the therapeutic nanoparticles may comprise at least one poly(vinyl ester) polymer. The poly(vinyl ester) polymer may be a copolymer such as a random copolymer. As a non-limiting example, the random copolymer may have a structure such as those described in International Application No. WO2013/032829 or U.S. Patent Publication No US2013/0121954, the contents of each of which are herein incorporated by reference in their entirety. In some embodiments, the poly(vinyl ester) polymers may be conjugated to the polynucleotides described herein.

In some embodiments, the therapeutic nanoparticle may comprise at least one diblock copolymer. The diblock copolymer may be, but it not limited to, a poly(lactic) acid-poly(ethylene)glycol copolymer (see, e.g., International Patent Publication No. WO2013/044219, the contents of which are herein incorporated by reference in their entirety). As a non-limiting example, the therapeutic nanoparticle may be used to treat cancer (see International publication No. WO2013/044219, the contents of which are herein incorporated by reference in their entirety).

In some embodiments, the therapeutic nanoparticles may comprise at least one cationic polymer described herein and/or known in the art.

In some embodiments, the therapeutic nanoparticles may comprise at least one amine-containing polymer such as, but not limited to polylysine, polyethylene imine, poly(amidoamine) dendrimers, poly(beta-amino esters) (see, e.g., U.S. Pat. No. 8,287,849, the contents of which are herein incorporated by reference in their entirety) and combinations thereof.

In some embodiments, the nanoparticles described herein may comprise an amine cationic lipid such as those described in International Patent Application No. WO2013/059496, the contents of which are herein incorporated by reference in their entirety. In some embodiments, the cationic lipids may have an amino-amine or an amino-amide moiety.

In some embodiments, the therapeutic nanoparticles may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In some embodiments, the degradable polyesters may include a PEG conjugation to form a PEGylated polymer.

In some embodiments, the synthetic nanocarriers may contain an immunostimulatory agent to enhance the immune response from delivery of the synthetic nanocarrier. As a non-limiting example, the synthetic nanocarrier may comprise a Th1 immunostimulatory agent, which may enhance a Th1-based response of the immune system (see International Pub No. WO2010/123569 and U.S. Publication No. US2011/0223201, the contents of each of which are herein incorporated by reference in their entirety).

In some embodiments, the synthetic nanocarriers may be formulated for targeted release. In some embodiments, the synthetic nanocarrier is formulated to release the polynucleotides at a specified pH and/or after a desired time interval. As a non-limiting example, the synthetic nanoparticle may be formulated to release the RNA (e.g., mRNA) vaccines after 24 hours and/or at a pH of 4.5 (see International Publication Nos. WO2010/138193 and WO2010/138194 and US Pub Nos. US2011/0020388 and US2011/0027217, each of which is herein incorporated by reference in their entireties).

In some embodiments, the synthetic nanocarriers may be formulated for controlled and/or sustained release of the polynucleotides described herein. As a non-limiting example, the synthetic nanocarriers for sustained release may be formulated by methods known in the art, described herein and/or as described in International Pub No. WO2010/138192 and US Pub No. 2010/0303850, each of which is herein incorporated by reference in their entirety.

In some embodiments, the RNA (e.g., mRNA) vaccine may be formulated for controlled and/or sustained release wherein the formulation comprises at least one polymer that is a crystalline side chain (CYSC) polymer. CYSC polymers are described in U.S. Pat. No. 8,399,007, herein incorporated by reference in its entirety.

In some embodiments, the synthetic nanocarrier may be formulated for use as a vaccine. In some embodiments, the synthetic nanocarrier may encapsulate at least one polynucleotide which encode at least one antigen. As a non-limiting example, the synthetic nanocarrier may include at least one antigen and an excipient for a vaccine dosage form (see International Publication No. WO2011/150264 and U.S. Publication No. US2011/0293723, the contents of each of which are herein incorporated by reference in their entirety). As another non-limiting example, a vaccine dosage form may include at least two synthetic nanocarriers with the same or different antigens and an excipient (see International Publication No. WO2011/150249 and U.S. Publication No. US2011/0293701, the contents of each of which are herein incorporated by reference in their entirety). The vaccine dosage form may be selected by methods described herein, known in the art and/or described in International Publication No. WO2011/150258 and U.S. Publication No. US2012/0027806, the contents of each of which are herein incorporated by reference in their entirety).

In some embodiments, the synthetic nanocarrier may comprise at least one polynucleotide which encodes at least one adjuvant. As non-limiting example, the adjuvant may comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a *Mycobacterium* (see, e.g., U.S. Pat. No. 8,241,610, the content of which is herein incorporated by reference in its entirety). In some embodiments, the synthetic nanocarrier may comprise at least one polynucleotide and an adjuvant. As a non-limiting example, the synthetic nanocarrier comprising and adjuvant may be formulated by the methods described in International Publication No. WO2011/150240 and U.S. Publication No. US2011/0293700, the contents of each of which are herein incorporated by reference in their entirety.

In some embodiments, the synthetic nanocarrier may encapsulate at least one polynucleotide that encodes a peptide, fragment or region from a virus. As a non-limiting example, the synthetic nanocarrier may include, but is not limited to, any of the nanocarriers described in International Publication No. WO2012/024621, WO2012/02629, WO2012/024632 and U.S. Publication No. US2012/0064110, US2012/0058153 and US2012/0058154, the contents of each of which are herein incorporated by reference in their entirety.

In some embodiments, the synthetic nanocarrier may be coupled to a polynucleotide which may be able to trigger a humoral and/or cytotoxic T lymphocyte (CTL) response (see, e.g., International Publication No. WO2013/019669, the contents of which are herein incorporated by reference in their entirety).

In some embodiments, the RNA (e.g., mRNA) vaccine may be encapsulated in, linked to and/or associated with zwitterionic lipids. Non-limiting examples of zwitterionic lipids and methods of using zwitterionic lipids are described in U.S. Patent Publication No. US2013/0216607, the contents of which are herein incorporated by reference in their entirety. In some aspects, the zwitterionic lipids may be used in the liposomes and lipid nanoparticles described herein.

In some embodiments, the RNA (e.g., mRNA) vaccine may be formulated in colloid nanocarriers as described in U.S. Patent Publication No. US2013/0197100, the contents of which are herein incorporated by reference in their entirety.

In some embodiments, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Publication No. US2012/0282343, the contents of which are herein incorporated by reference in their entirety.

In some embodiments, LNPs comprise the lipid KL52 (an amino-lipid disclosed in U.S. Application Publication No. 2012/0295832, the contents of which are herein incorporated by reference in their entirety. Activity and/or safety (as measured by examining one or more of ALT/AST, white blood cell count and cytokine induction, for example) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, RNA (e.g., mRNA) vaccine may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, or less than 1000 um.

In some embodiments, RNA (e.g., mRNA) vaccines may be delivered using smaller LNPs, which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nm, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Examples of microfluidic mixers may include, but are not limited to, a slit interdigital micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51, the contents of each of which are herein incorporated by reference in their entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, the contents of each of which are herein incorporated by reference in their entirety.

In some embodiments, the RNA (e.g., mRNA) vaccine of the present disclosure may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In some embodiments, the RNA (e.g., mRNA) vaccines of the present disclosure may be formulated in lipid nanoparticles created using microfluidic technology (see, e.g., Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (see, e.g., Abraham et al. Chaotic Mixer for Microchannels. Science, 2002 295: 647-651, the contents of which are herein incorporated by reference in their entirety).

In some embodiments, the RNA (e.g., mRNA) vaccines of the present disclosure may be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In some embodiments, the RNA (e.g., mRNA) vaccines of the disclosure may be formulated for delivery using the drug encapsulating microspheres described in International Patent Publication No. WO2013063468 or U.S. Pat. No. 8,440,614, the contents of each of which are herein incorporated by reference in their entirety. The microspheres may comprise a compound of the formula (I), (II), (III), (IV), (V) or (VI) as described in International Patent Publication No. WO2013/063468, the contents of which are herein incorporated by reference in their entirety. In some embodiments, the amino acid, peptide, polypeptide, lipids (APPL) are useful in delivering the RNA (e.g., mRNA) vaccines of the disclosure to cells (see International Patent Publication No. WO2013/063468, the contents of which are herein incorporated by reference in their entirety).

In some embodiments, the RNA (e.g., mRNA) vaccines of the disclosure may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In some embodiments, the lipid nanoparticles may have a diameter from about 10 to 500 nm.

In some embodiments, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the lipid nanoparticle may be a limit size lipid nanoparticle described in International Patent Publication No. WO2013/059922, the contents of which are herein incorporated by reference in their entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In some embodiments, the limit size lipid nanoparticle may comprise a polyethylene glycol-lipid such as, but not limited to, DLPE-PEG, DMPE-PEG, DPPC-PEG and DSPE-PEG.

In some embodiments, the RNA (e.g., mRNA) vaccines may be delivered, localized and/or concentrated in a specific location using the delivery methods described in International Patent Publication No. WO2013/063530, the contents of which are herein incorporated by reference in their entirety. As a non-limiting example, a subject may be administered an empty polymeric particle prior to, simultaneously with or after delivering the RNA (e.g., mRNA) vaccines to the subject. The empty polymeric particle undergoes a change in volume once in contact with the subject and becomes lodged, embedded, immobilized or entrapped at a specific location in the subject.

In some embodiments, the RNA (e.g., mRNA) vaccines may be formulated in an active substance release system (see, e.g., U.S. Patent Publication No. US2013/0102545, the contents of which are herein incorporated by reference in their entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In some embodiments, the RNA (e.g., mRNA) vaccines may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO2013/052167, the contents of which are herein incorporated by reference in their entirety. As another non-limiting example, the nanoparticle described in International Patent Publication No. WO2013/052167, the contents of which are herein incorporated by reference in their entirety, may be used to deliver the RNA (e.g., mRNA) vaccines described herein.

In some embodiments, the RNA (e.g., mRNA) vaccines may be formulated in porous nanoparticle-supported lipid bilayers (protocells). Protocells are described in International Patent Publication No. WO2013/056132, the contents of which are herein incorporated by reference in their entirety.

In some embodiments, the RNA (e.g., mRNA) vaccines described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in their entirety. As another non-limiting example, the polymer nanoparticle for oral and parenteral formulations may be made by the methods described in European Patent No. EP2073848B1, the contents of which are herein incorporated by reference in their entirety.

In some embodiments, the RNA (e.g., mRNA) vaccines described herein may be formulated in nanoparticles used in imaging. The nanoparticles may be liposome nanoparticles such as those described in U.S. Patent Publication No US2013/0129636, herein incorporated by reference in its entirety. As a non-limiting example, the liposome may comprise gadolinium(III)2-{4,7-bis-carboxymethyl-10-[(N,N-distearylamidomethyl-N'-amido-methyl]-1,4,7,10-tetra-azacyclododec-1-yl}-acetic acid and a neutral, fully saturated phospholipid component (see, e.g., U.S. Patent Publication No US2013/0129636, the contents of which are herein incorporated by reference in their entirety).

In some embodiments, the nanoparticles which may be used in the present disclosure are formed by the methods described in U.S. Patent Application No. US2013/0130348, the contents of which are herein incorporated by reference in their entirety.

The nanoparticles of the present disclosure may further include nutrients such as, but not limited to, those which deficiencies can lead to health hazards from anemia to neural tube defects (see, e.g., the nanoparticles described in International Patent Publication No WO2013/072929, the contents of which are herein incorporated by reference in their entirety). As a non-limiting example, the nutrient may be iron in the form of ferrous, ferric salts or elemental iron, iodine, folic acid, vitamins or micronutrients.

In some embodiments, the RNA (e.g., mRNA) vaccines of the present disclosure may be formulated in a swellable nanoparticle. The swellable nanoparticle may be, but is not limited to, those described in U.S. Pat. No. 8,440,231, the contents of which are herein incorporated by reference in their entirety. As a non-limiting embodiment, the swellable nanoparticle may be used for delivery of the RNA (e.g., mRNA) vaccines of the present disclosure to the pulmonary system (see, e.g., U.S. Pat. No. 8,440,231, the contents of which are herein incorporated by reference in their entirety).

The RNA (e.g., mRNA) vaccines of the present disclosure may be formulated in polyanhydride nanoparticles such as, but not limited to, those described in U.S. Pat. No. 8,449,916, the contents of which are herein incorporated by reference in their entirety.

The nanoparticles and microparticles of the present disclosure may be geometrically engineered to modulate macrophage and/or the immune response. In some embodiments, the geometrically engineered particles may have varied shapes, sizes and/or surface charges in order to incorporated the polynucleotides of the present disclosure for targeted delivery such as, but not limited to, pulmonary delivery (see, e.g., International Publication No WO2013/082111, the contents of which are herein incorporated by reference in their entirety). Other physical features the geometrically engineering particles may have include, but are not limited to, fenestrations, angled arms, asymmetry and surface roughness, charge which can alter the interactions with cells and tissues. As a non-limiting example, nanoparticles of the present disclosure may be made by the methods described in International Publication No WO2013/082111, the contents of which are herein incorporated by reference in their entirety.

In some embodiments, the nanoparticles of the present disclosure may be water soluble nanoparticles such as, but not limited to, those described in International Publication No. WO2013/090601, the contents of which are herein incorporated by reference in their entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In some embodiments the nanoparticles of the present disclosure may be developed by the methods described in U.S. Patent Publication No. US2013/0172406, the contents of which are herein incorporated by reference in their entirety.

In some embodiments, the nanoparticles of the present disclosure are stealth nanoparticles or target-specific stealth nanoparticles such as, but not limited to, those described in U.S. Patent Publication No. US2013/0172406, the contents of which are herein incorporated by reference in their entirety. The nanoparticles of the present disclosure may be made by the methods described in U.S. Patent Publication No. US2013/0172406, the contents of which are herein incorporated by reference in their entirety.

In some embodiments, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In some embodiments, the nanoparticle may be a nanoparticle-nucleic acid hybrid structure having a high density nucleic acid layer. As a non-limiting example, the nanoparticle-nucleic acid hybrid structure may made by the methods described in U.S. Patent Publication No. US2013/0171646, the contents of which are herein incorporated by reference in their entirety. The nanoparticle may comprise a nucleic acid such as, but not limited to, polynucleotides described herein and/or known in the art.

At least one of the nanoparticles of the present disclosure may be embedded in in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013/123523, the contents of which are herein incorporated by reference in their entirety.

In some embodiments the RNA (e.g., mRNA) vaccine may be associated with a cationic or polycationic compounds, including protamine, nucleoline, spermine or spermidine, or other cationic peptides or proteins, such as poly-L-lysine (PLL), polyarginine, basic polypeptides, cell penetrating peptides (CPPs), including HIV-binding peptides, HIV-1 Tat (HIV), Tat-derived peptides, Penetratin, VP$^{22}$ derived or analog peptides, Pestivirus Erns, HSV, VP$^{22}$ (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIs1, FGF, Lactoferrin, Transportan, Buforin-2, Bac715-24, SynB, SynB, pVEC, hCT-derived peptides, SAP, histones, cationic polysaccharides, for example chitosan, polybrene, cationic polymers, e.g. polyethyleneimine (PEI), cationic lipids, e.g. DOTMA: [1-(2,3-sioleyloxy) propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS: Dioctadecylamidoglicylspermin, DIMRI: Dimyristooxypropyl dimethyl hydroxyethyl ammonium bromide, DOTAP: dioleoyloxy-3-(trimethylammonio)propane, DC-6-14: O,O-ditetradecanoyl-N-.alpha.-trimethylammonioacetyl)diethanolamine chloride, CLIP 1: rac-[(2,3-dioctadecyloxypropyl) (2-hydroxyethyl)]-dimethylammonium chloride, CLIP6: rac-[2(2,3-dihexadecyloxypropyloxymethyloxy)ethyl]-trimethylammonium, CLIP9: rac-[2(2,3-dihexadecyloxypropyloxysuccinyloxy)ethyl]-trimethylammo-nium, oligofectamine, or cationic or polycationic polymers, e.g. modified polyaminoacids, such as beta-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly (ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole), etc.

In other embodiments the RNA (e.g., mRNA) vaccine is not associated with a cationic or polycationic compounds.

In some embodiments, a nanoparticle comprises compounds of Formula (I):

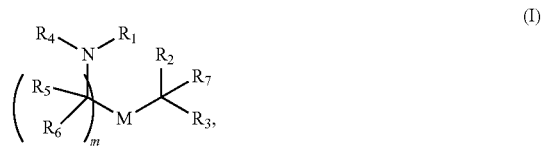

or a salt or isomer thereof, wherein:

$R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a carbocycle, heterocycle, —OR, —O(CH$_2$)$_n$N(R)$_2$, —C(O) OR, —OC(O)R, —CX$_3$, —CX$_2$H, —CXH$_2$, —CN, —N (R)$_2$, —C(O)N(R)$_2$, —N(R)C(O)R, —N(R)S(O)$_2$R, —N(R) C(O)N(R)$_2$, —N(R)C(S)N(R)$_2$, —N(R)R$_8$, —O(CH$_2$)$_n$OR, —N(R)C(=NR$_9$)N(R)$_2$, —N(R)C(=CHR$_9$)N(R)$_2$, —OC (O)N(R)$_2$, —N(R)C(O)OR, —N(OR)C(O)R, —N(OR)S (O)$_2$R, —N(OR)C(O)OR, —N(OR)C(O)N(R)$_2$, —N(OR)C (S)N(R)$_2$, —N(OR)C(=NR$_9$)N(R)$_2$, —N(OR)C(=CHR$_9$) N(R)$_2$, —C(=NR$_9$)N(R)$_2$, —C(=NR$_9$)R, —C(O)N(R)OR, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O) (OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when $R_4$ is —$(CH_2)_nQ$, —$(CH_2)_n$CHQR, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR″, and —R*OR″, or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$, —$O(CH_2)_nOR$, —N(R)C($=NR_9$)$N(R)_2$, —N(R)C($=CHR_9$)$N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —N(OR)C(S)N$(R)_2$, —N(OR)C($=NR_9$)$N(R)_2$, —N(OR)C($=CHR_9$)N$(R)_2$, —C($=NR_9$)$N(R)_2$, —C($=NR_9$)R, —C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M′ are independently selected from —C(O)O—, —OC(O)—, —C(O)N(R′)—, —N(R′)C(O)—, —C(O)—, —C(S)—, —C(S)S—, —SC(S)—, —CH(OH)—, —P(O)(OR′)O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R′ is independently selected from the group consisting of $C_{1-18}$ alkyl, $C_{2-18}$ alkenyl, —R*YR″, —YR″, and H;

each R″ is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR″, and —R*OR″, or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heterocycle having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$, —$O(CH_2)_nOR$, —N(R)C($=NR_9$)$N(R)_2$, —N(R)C($=CHR_9$)$N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —N(OR)C(S)N$(R)_2$, —N(OR)C($=NR_9$)$N(R)_2$, —N(OR)C($=CHR_9$)N$(R)_2$, —C($=NR_9$)R, —C(O)N(R)OR, and —C($=NR_9$)N$(R)_2$, and each n is independently selected from 1, 2, 3, 4, and 5; and when Q is a 5- to 14-membered heterocycle and (i) $R_4$ is —$(CH_2)_nQ$ in which n is 1 or 2, or (ii) $R_4$ is —$(CH_2)_n$CHQR in which n is 1, or (iii) $R_4$ is —CHQR, and —$CQ(R)_2$, then Q is either a 5- to 14-membered heteroaryl or 8- to 14-membered heterocycloalkyl;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M′ are independently selected from —C(O)O—, —OC(O)—, —C(O)N(R′)—, —N(R′)C(O)—, —C(O)—, —C(S)—, —C(S)S—, —SC(S)—, —CH(OH)—, —P(O)(OR′)O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R′ is independently selected from the group consisting of $C_{1-18}$ alkyl, $C_{2-18}$ alkenyl, —R*YR″, —YR″, and H;

each R″ is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR″, —YR″, and —R″M′R′;

$R_2$ and $R_3$ are independently selected from the group consisting of H, $C_{1-14}$ alkyl, $C_{2-14}$ alkenyl, —R*YR″, —YR″, and —R*OR″, or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —(CH$_2$)$_n$Q or —(CH$_2$)$_n$CHQR, where Q is —N(R)$_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —(CH$_2$)$_n$Q, —(CH$_2$)$_n$CHQR, —CHQR, and —CQ(R)$_2$, where Q is —N(R)$_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those of Formula (IA):

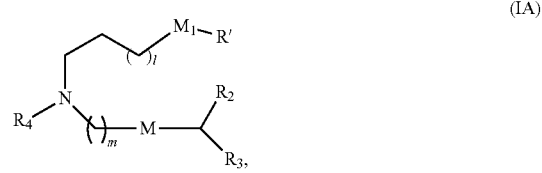

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —(CH$_2$)$_n$Q, in which Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (II):

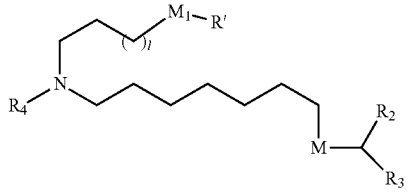
(II)

or a salt or isomer thereof, wherein l is selected from 1, 2, 3, 4, and 5; $M_1$ is a bond or M'; $R_4$ is unsubstituted $C_{1-3}$ alkyl, or —$(CH_2)_nQ$, in which n is 2, 3, or 4, and Q is OH, —NHC(S)N(R)$_2$, —NHC(O)N(R)$_2$, —N(R)C(O)R, —N(R)S(O)$_2$R, —N(R)R$_8$, —NHC($=$NR$_9$)N(R)$_2$, —NHC($=$CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (IIa), (IIb), (IIc), or (IIe):

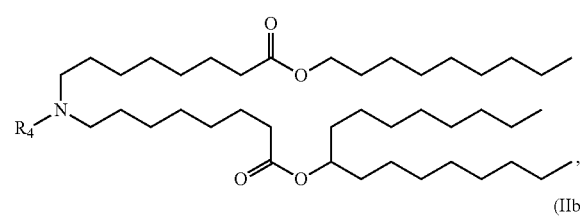
(IIa)

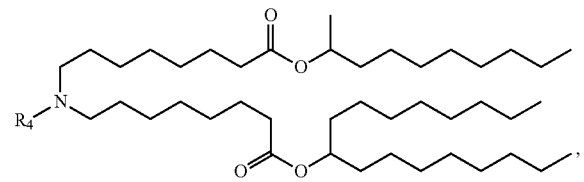
(IIb)

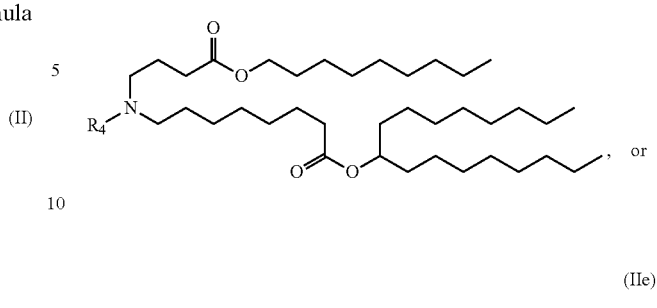
(IIc)

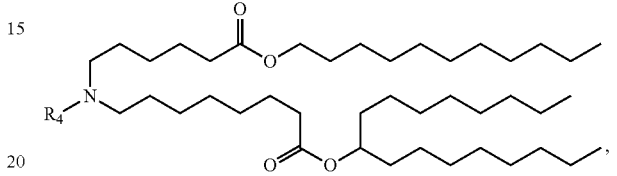
(IIe)

or a salt or isomer thereof, wherein $R_4$ is as described herein.

In some embodiments, a subset of compounds of Formula (I) includes those of Formula (IId):

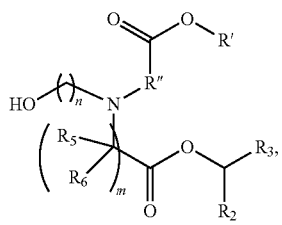
(IId)

or a salt or isomer thereof, wherein n is 2, 3, or 4; and m, R', R", and $R_2$ through $R_6$ are as described herein. For example, each of $R_2$ and $R_3$ may be independently selected from the group consisting of $C_{5-14}$ alkyl and $C_{5-14}$ alkenyl.

In some embodiments, the compound of Formula (I) is selected from the group consisting of:

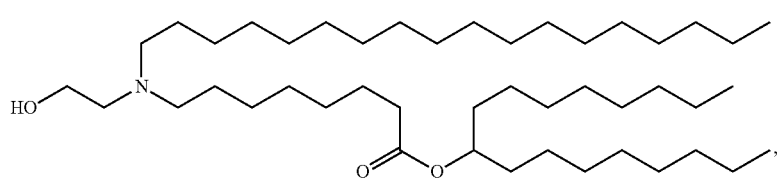
(Compound 1)

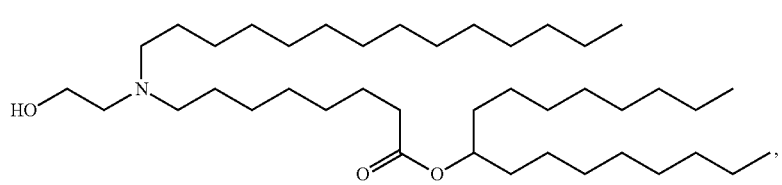
(Compound 2)

-continued
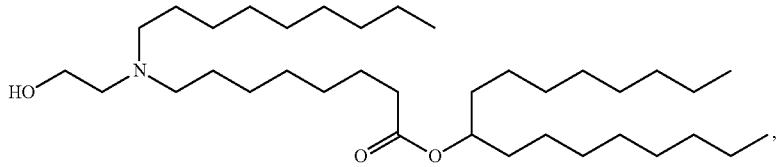
(Compound 3)
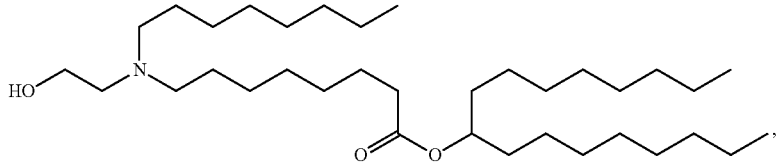
(Compound 4)
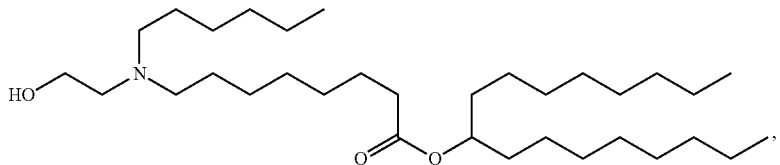
(Compound 5)
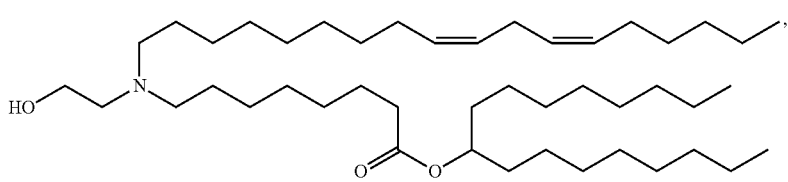
(Compound 6)
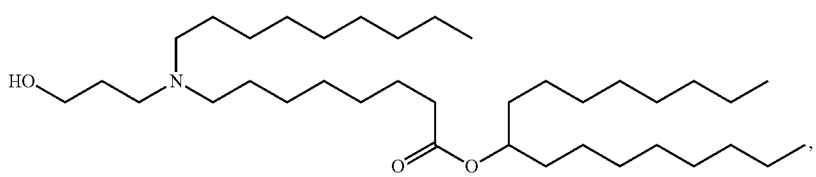
(Compound 7)
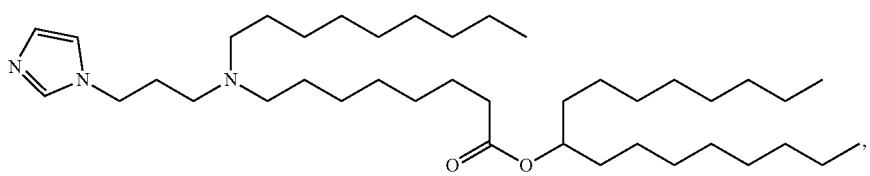
(Compound 8)
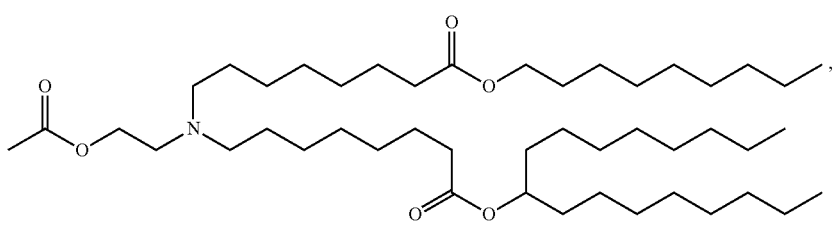
(Compound 9)
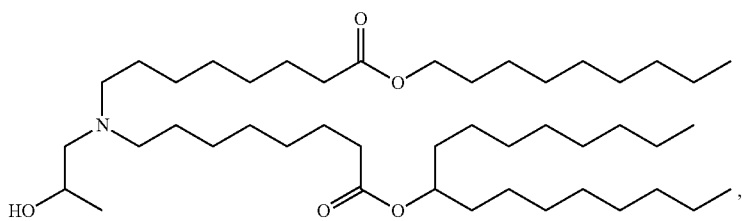
(Compound 10)

-continued
(Compound 11)
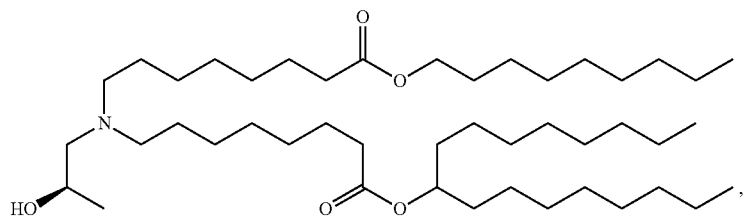
(Compound 12)
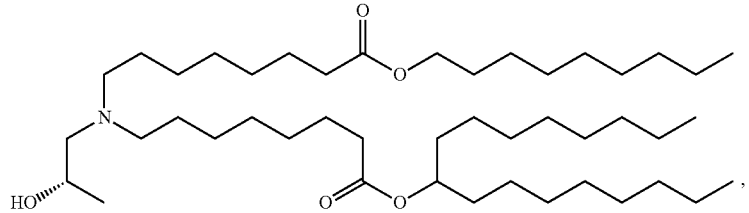
(Compound 13)
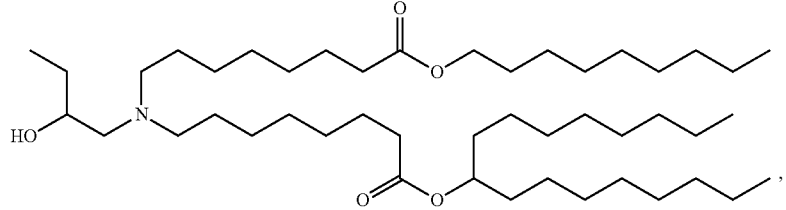
(Compound 14)
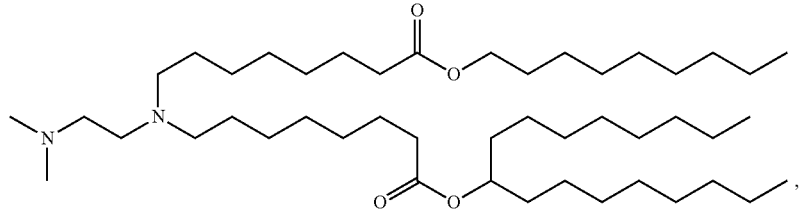
(Compound 15)
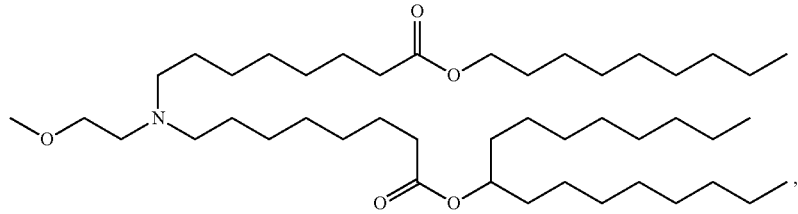
(Compound 16)
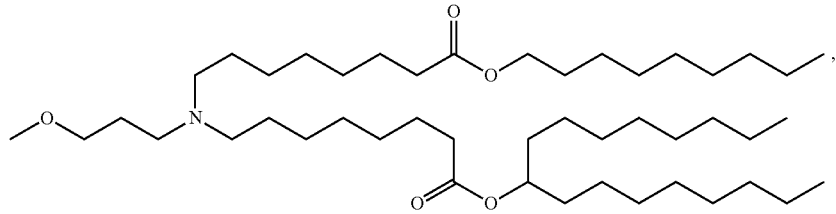
(Compound 17)
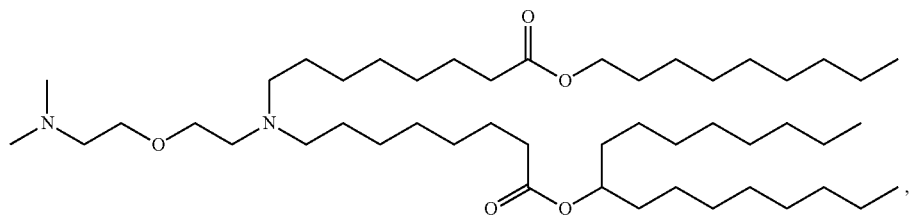

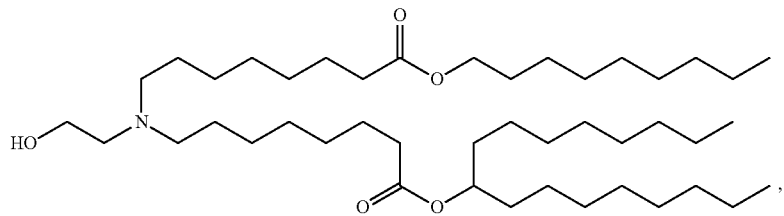
(Compound 18)
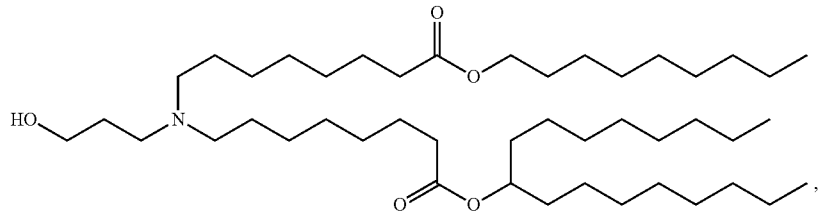
(Compound 19)
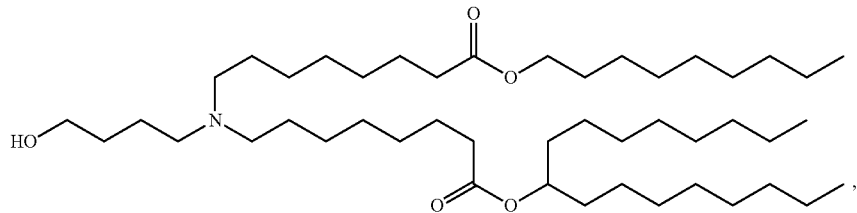
(Compound 20)
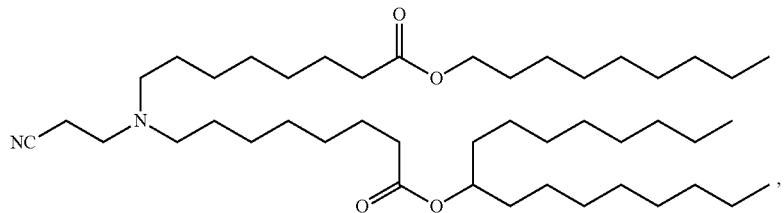
(Compound 21)
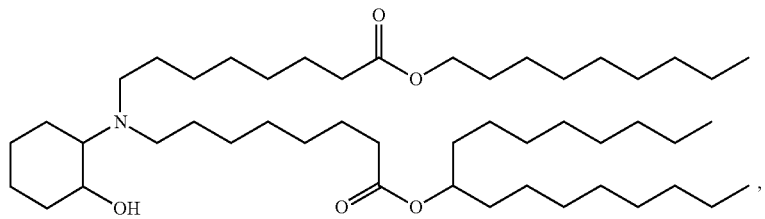
(Compound 22)
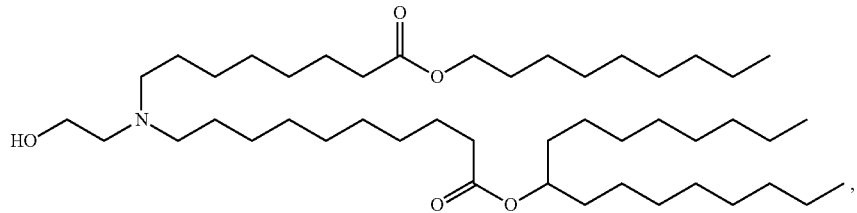
(Compound 23)
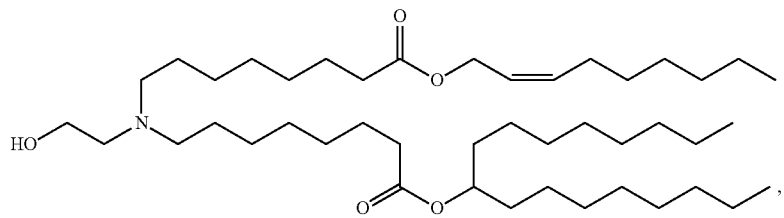
(Compound 24)

(Compound 25)
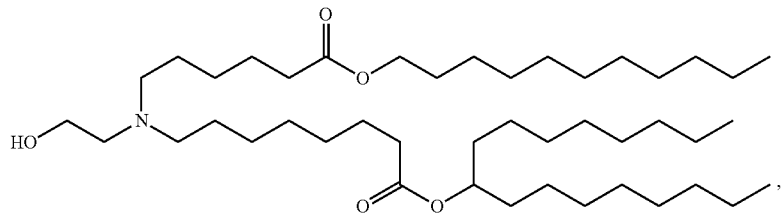
(Compound 26)
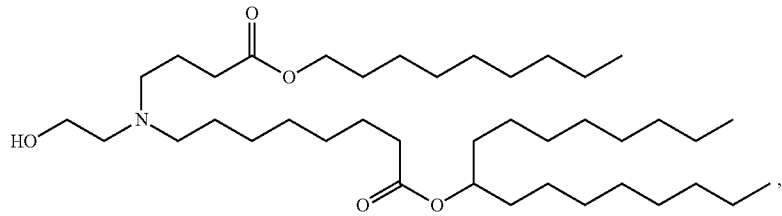
(Compound 27)
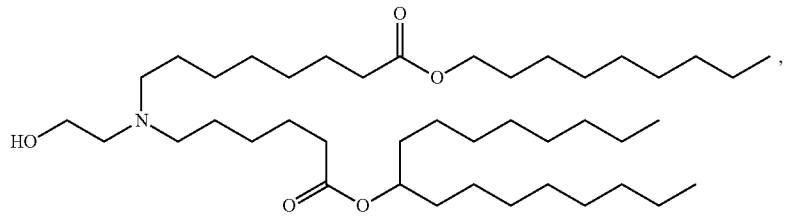
(Compound 28)
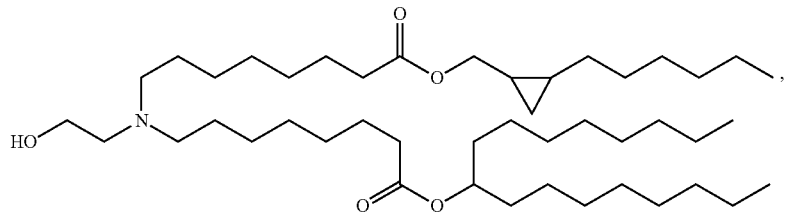
(Compound 29)
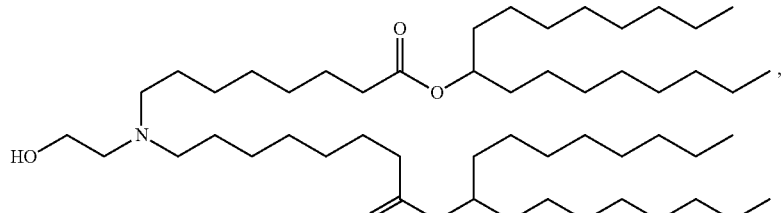
(Compound 30)
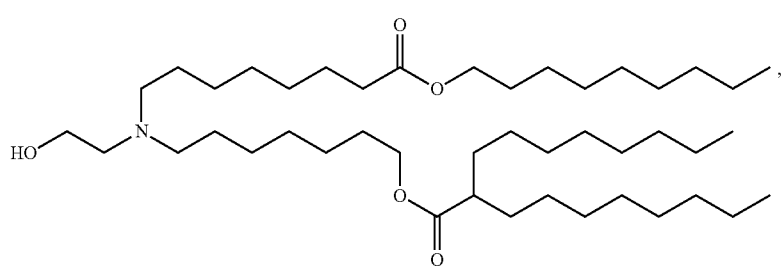
(Compound 31)
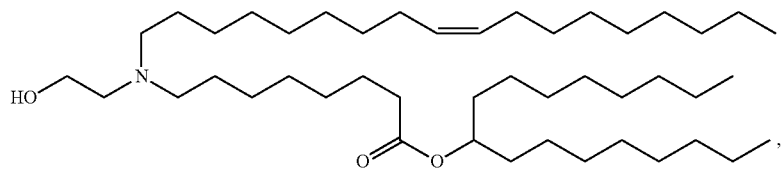

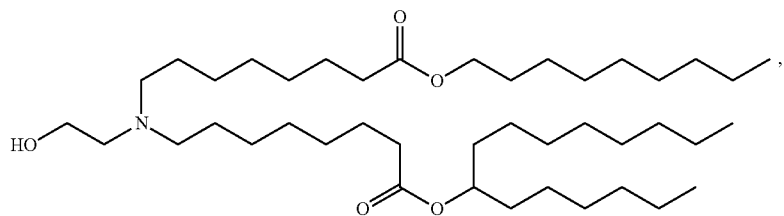
(Compound 32)
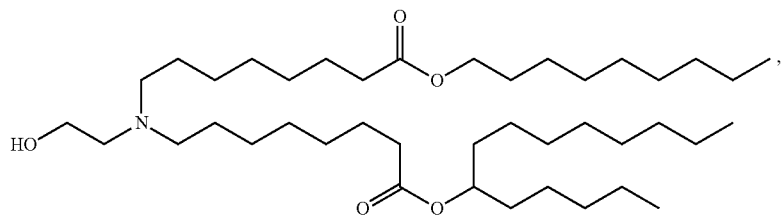
(Compound 33)
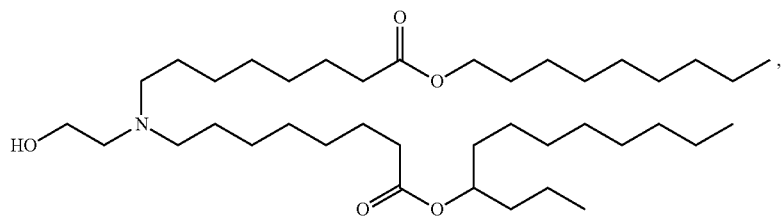
(Compound 34)
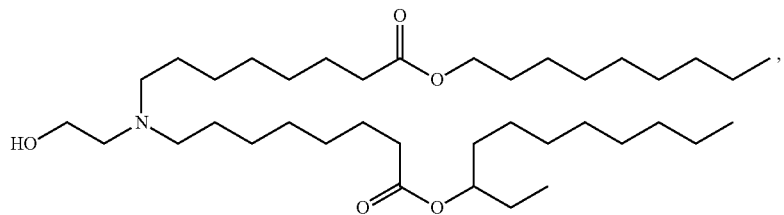
(Compound 35)
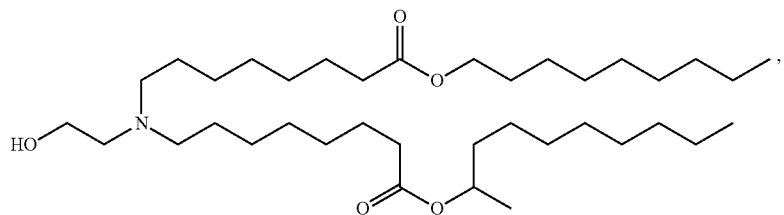
(Compound 36)
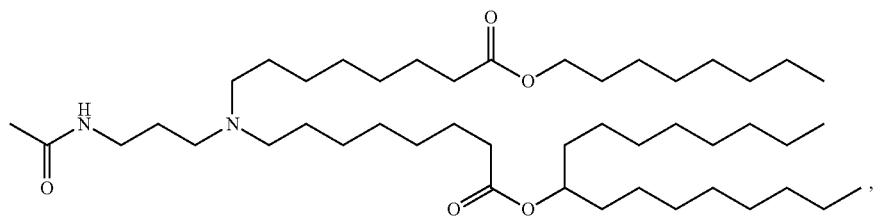
(Compound 37)
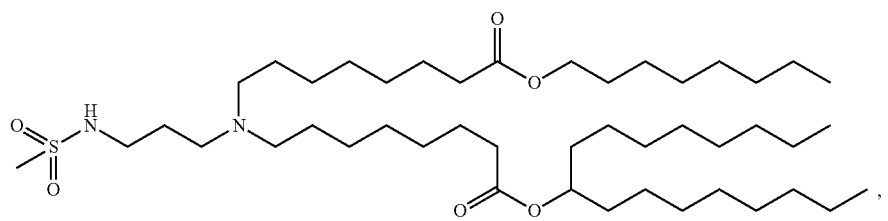
(Compound 38)

(Compound 39)
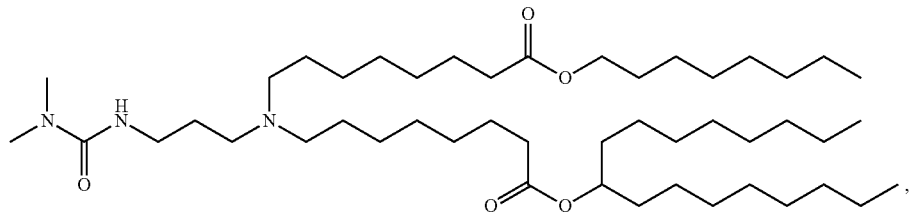
(Compound 40)
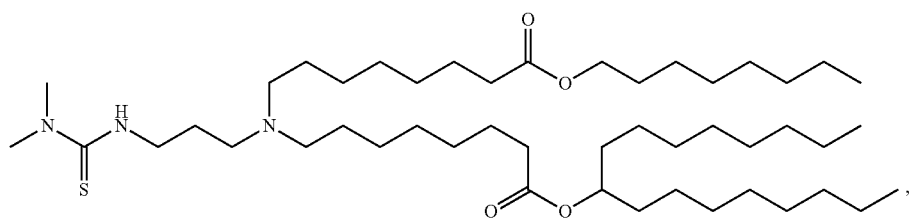
(Compound 41)
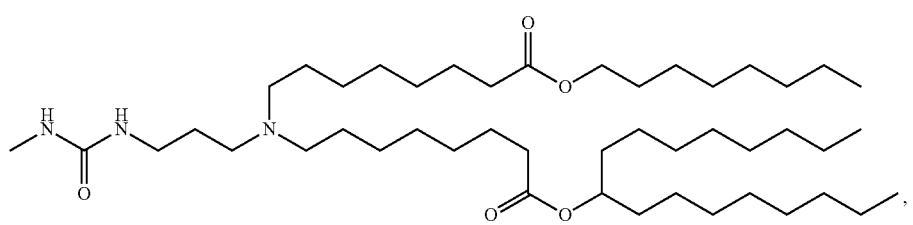
(Compound 42)
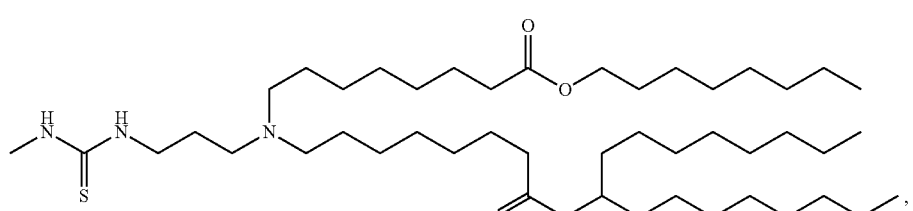
(Compound 43)
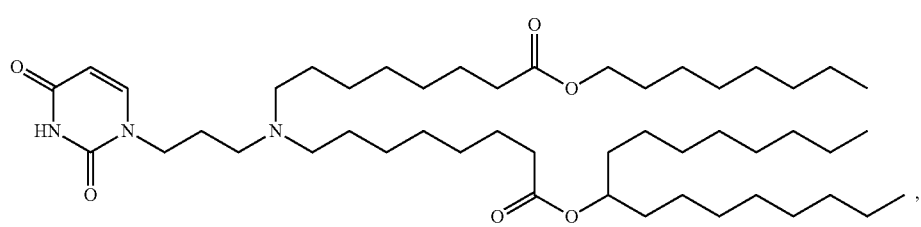
(Compound 44)
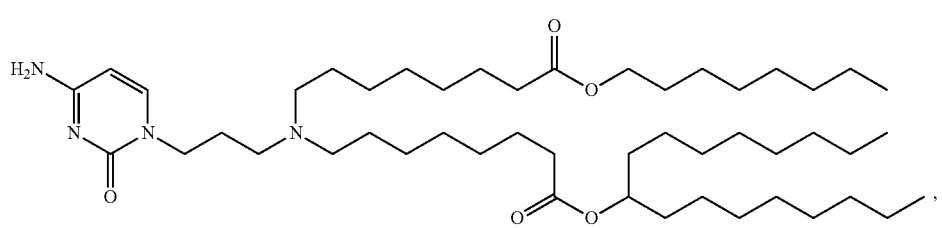
(Compound 45)
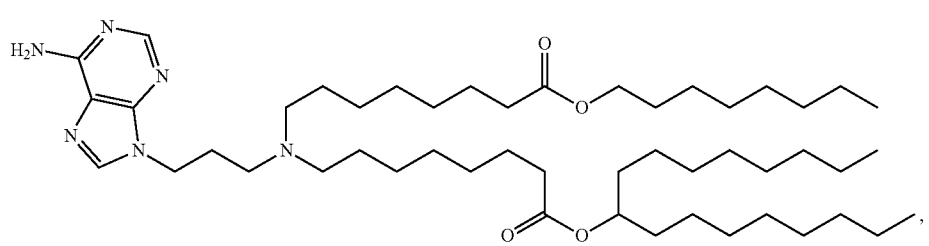

(Compound 46)
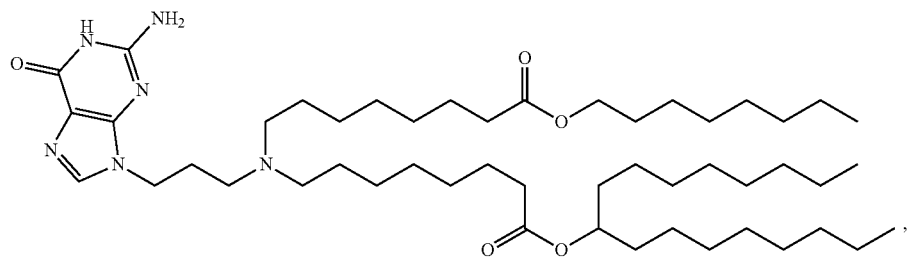
(Compound 47)
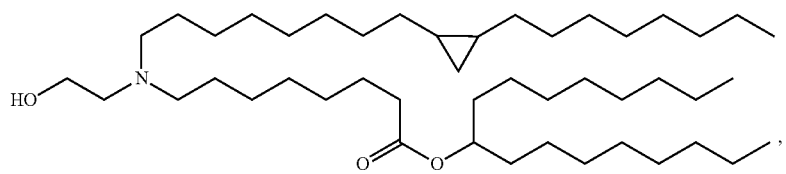
(Compound 48)
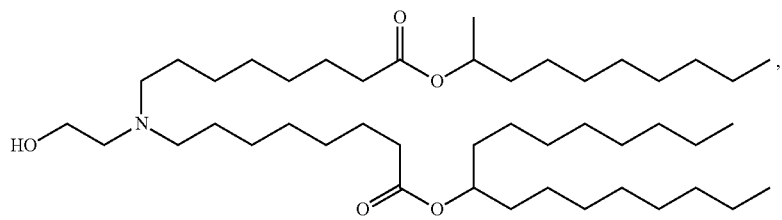
(Compound 49)
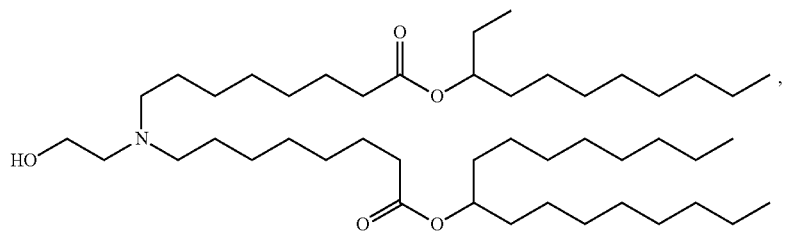
(Compound 50)
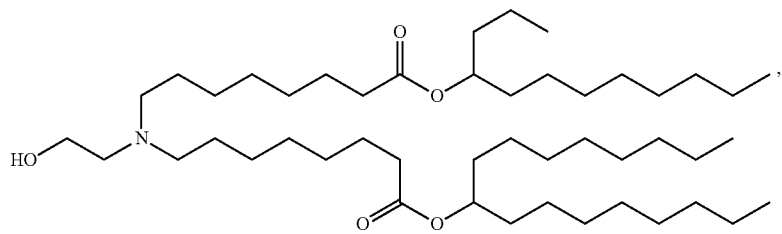
(Compound 51)
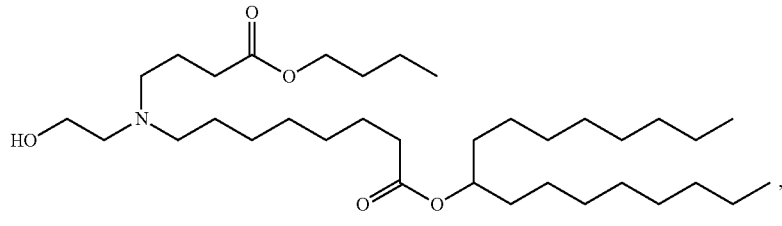
(Compound 52)
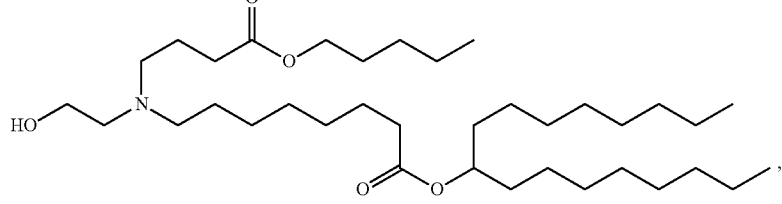

-continued
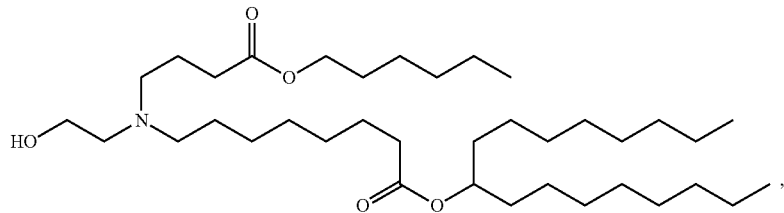
(Compound 53)
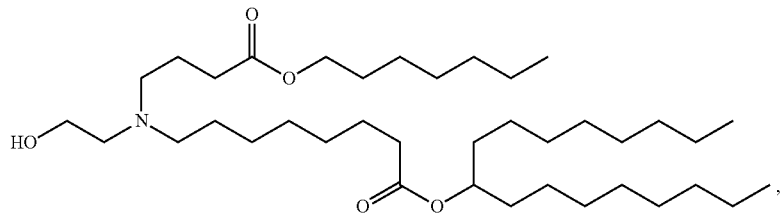
(Compound 54)
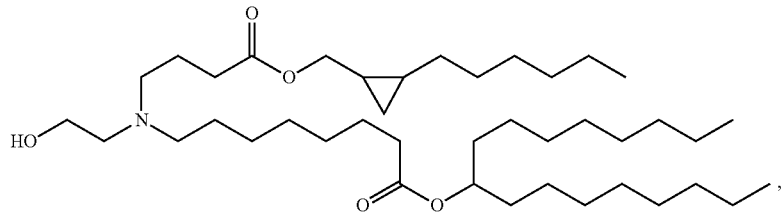
(Compound 55)
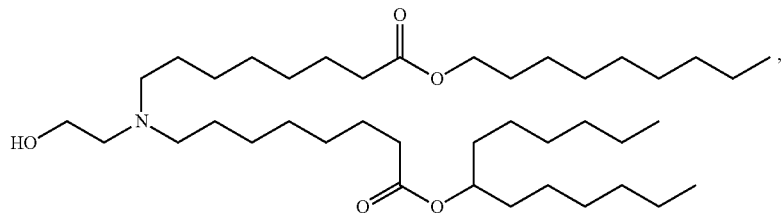
(Compound 56)
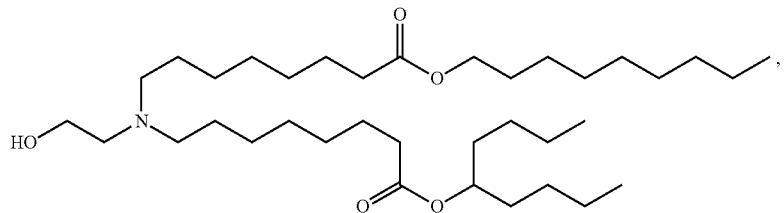
(Compound 57)
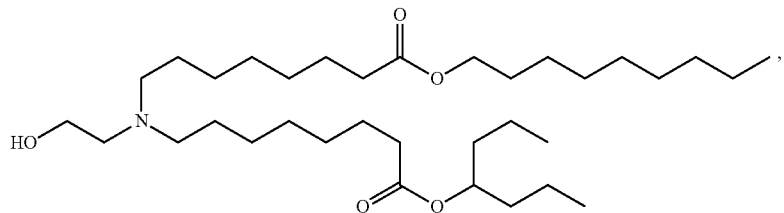
(Compound 58)
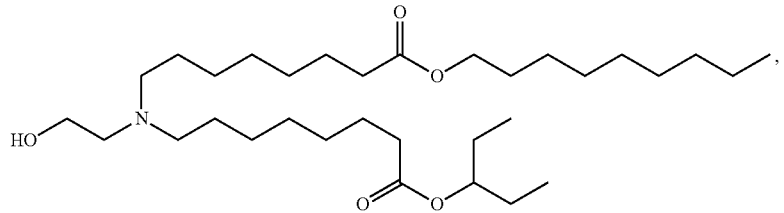
(Compound 59)

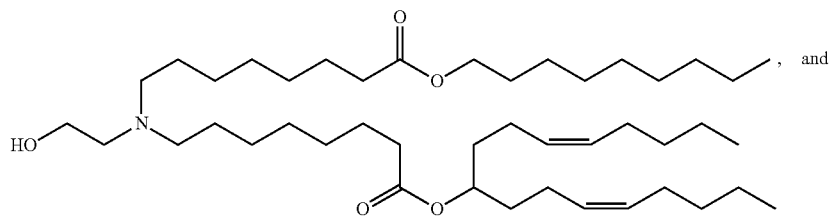
(Compound 60)
, and
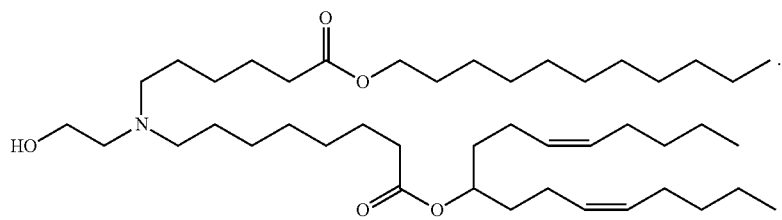
(Compound 61)
.
In further embodiments, the compound of Formula (I) is selected from the group consisting of:
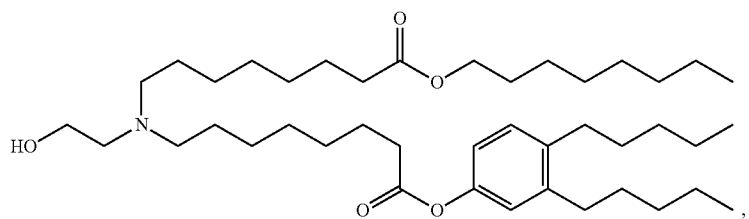
(Compound 62)
,
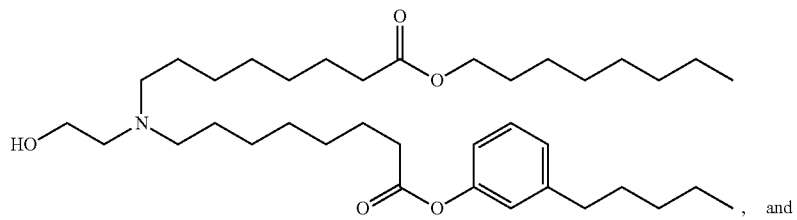
(Compound 63)
, and
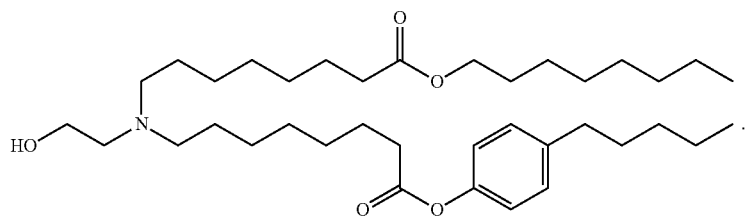
(Compound 64)
.

In some embodiments, the compound of Formula (I) is selected from the group consisting of:
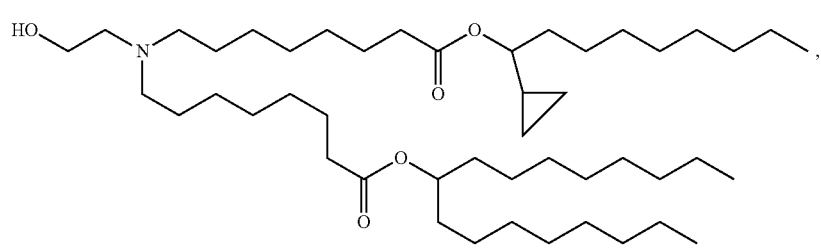
(Compound 65)
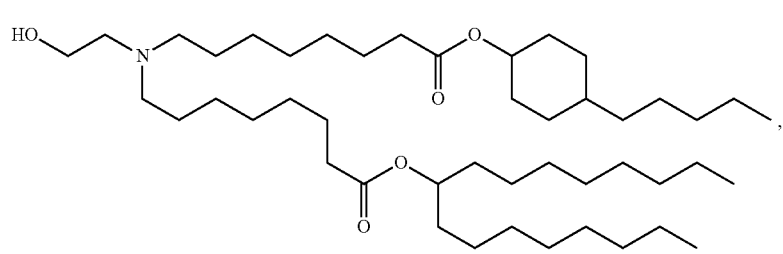
(Compound 66)
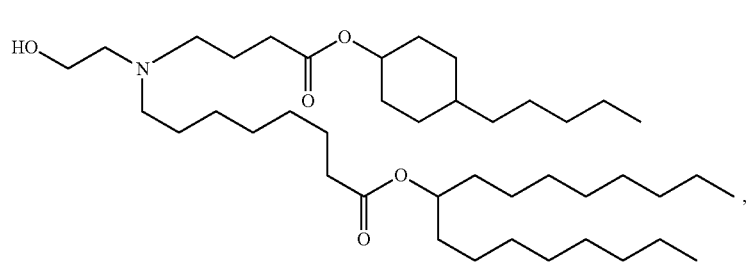
(Compound 67)
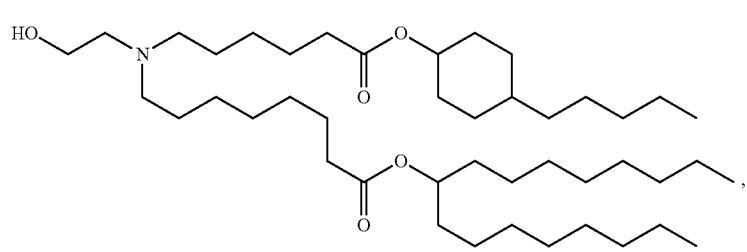
(Compound 68)
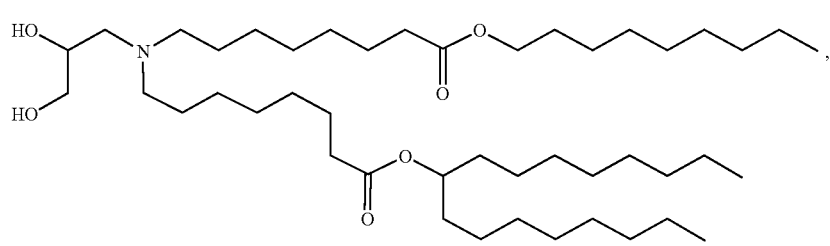
(Compound 69)
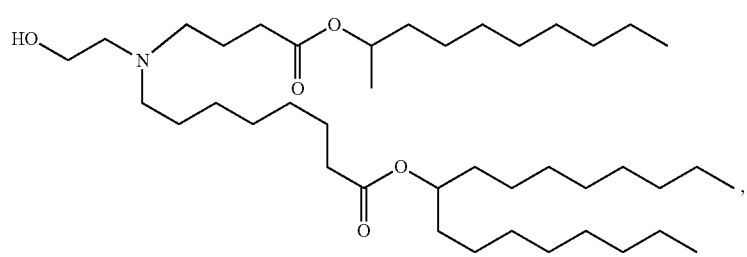
(Compound 70)

-continued
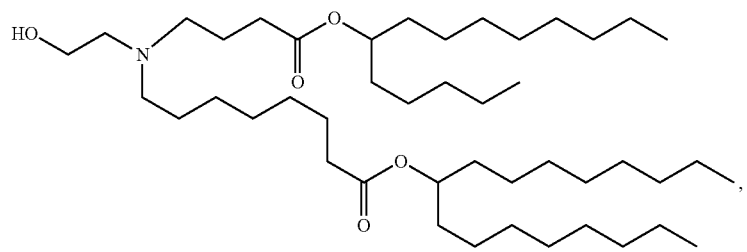
(Compound 71)
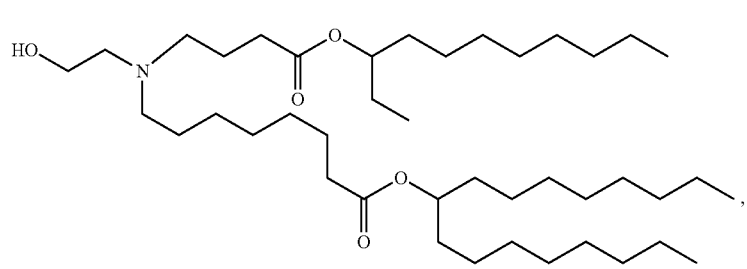
(Compound 72)
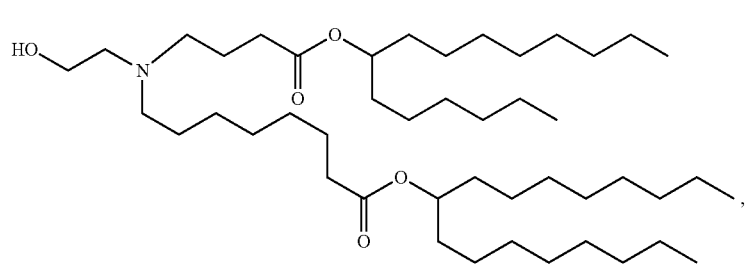
(Compound 73)
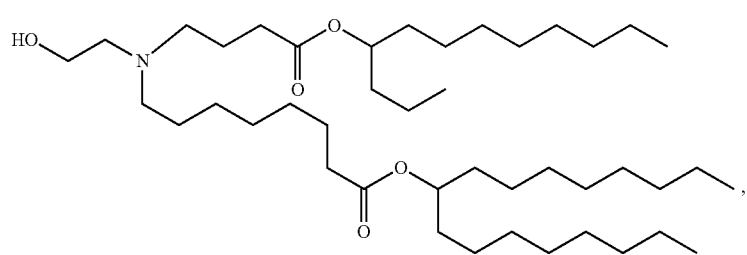
(Compound 74)
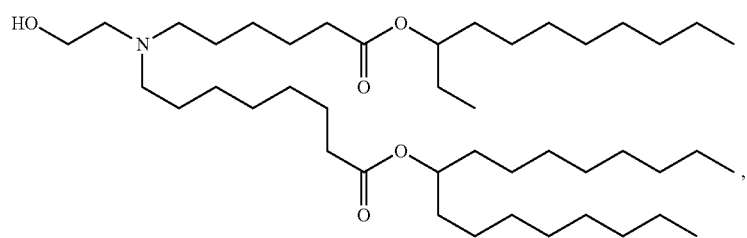
(Compound 75)
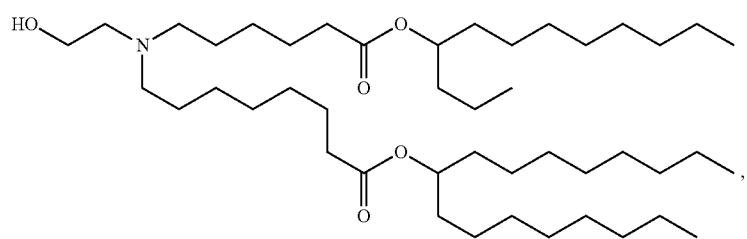
(Compound 76)

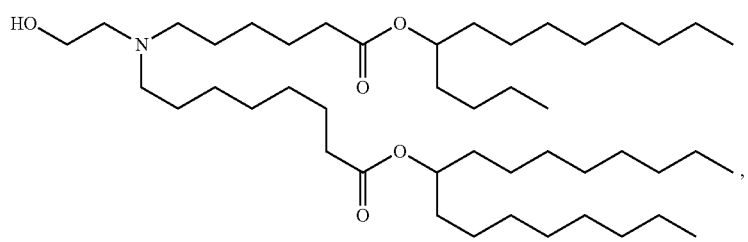
(Compound 77)
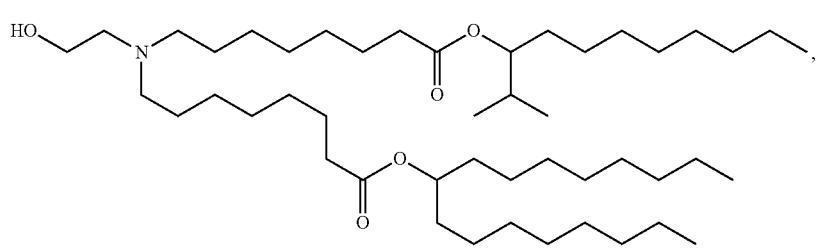
(Compound 78)
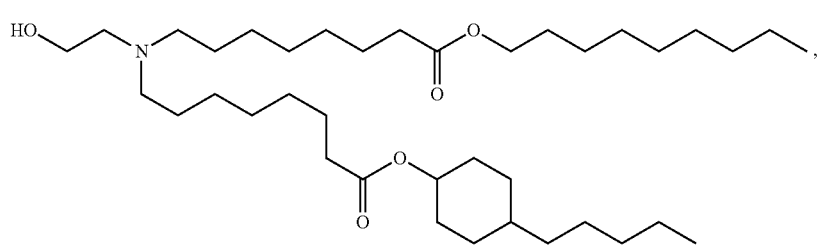
(Compound 79)
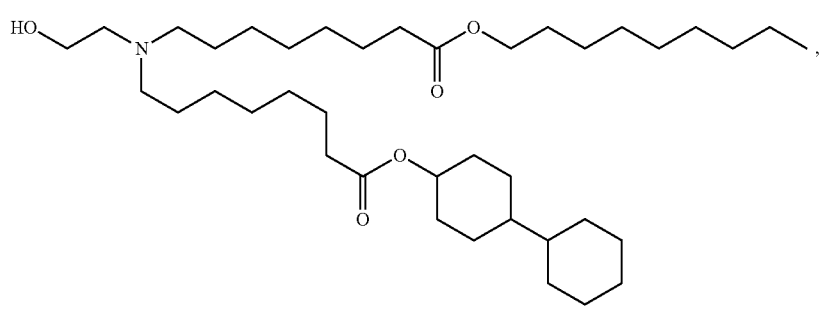
(Compound 80)
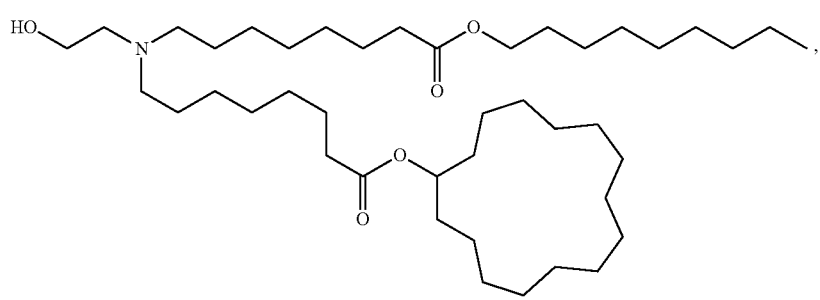
(Compound 81)
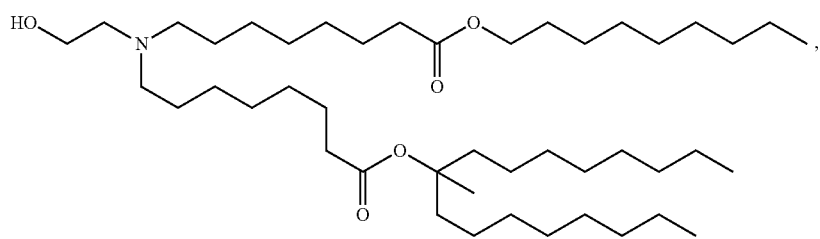
(Compound 82)

-continued
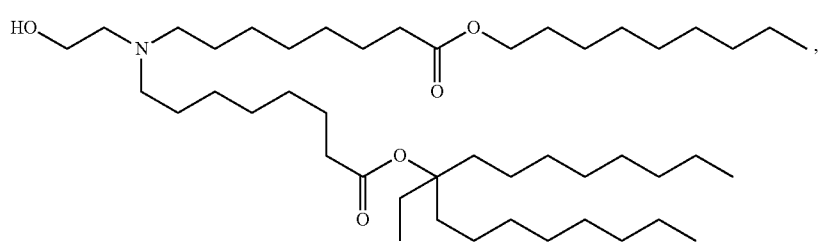
(Compound 83)
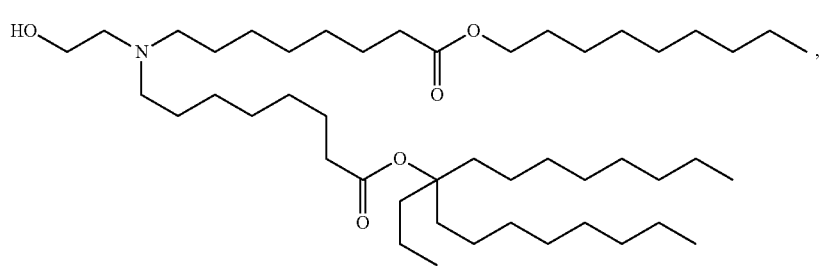
(Compound 84)
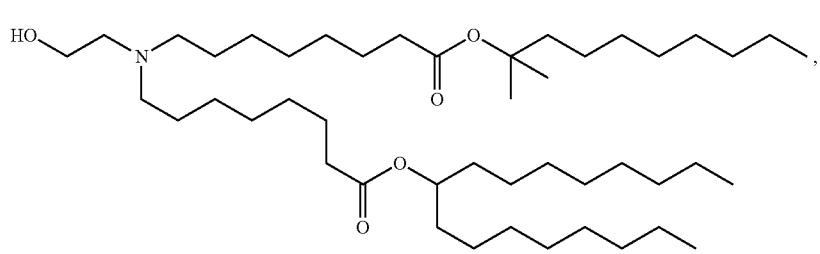
(Compound 85)
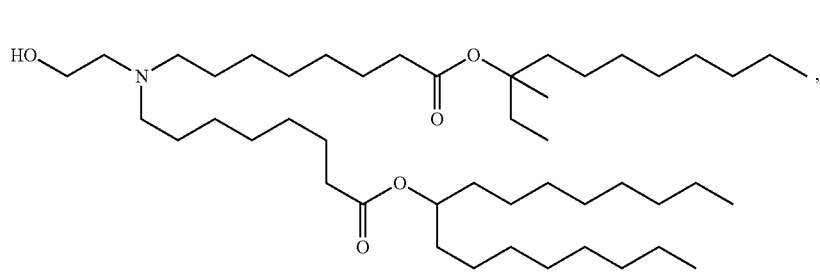
(Compound 86)
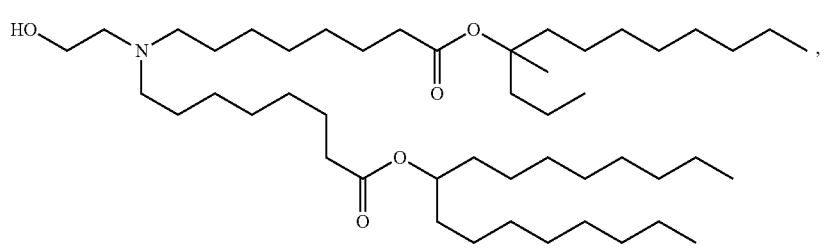
(Compound 87)
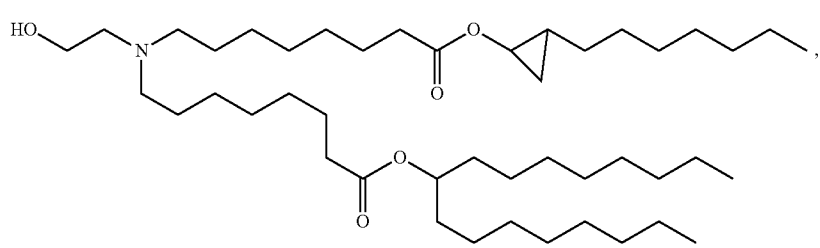
(Compound 88)

-continued
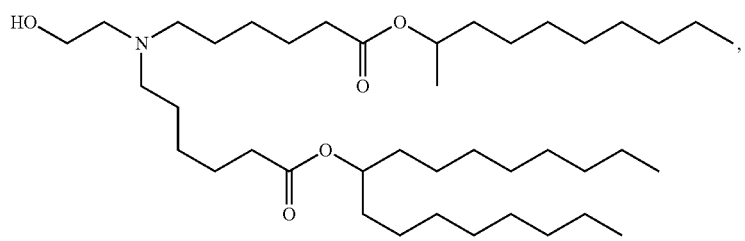
(Compound 89)
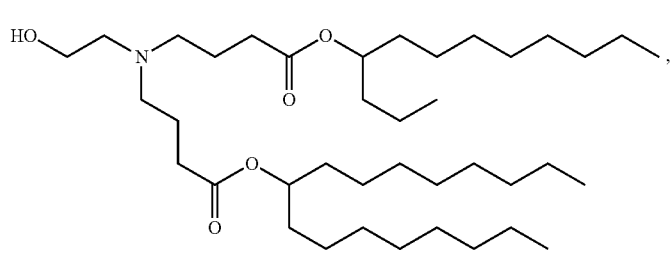
(Compound 90)
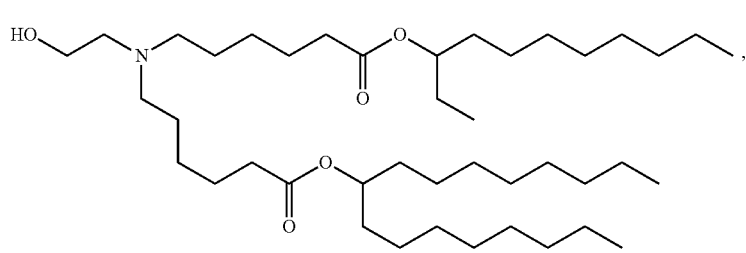
(Compound 91)
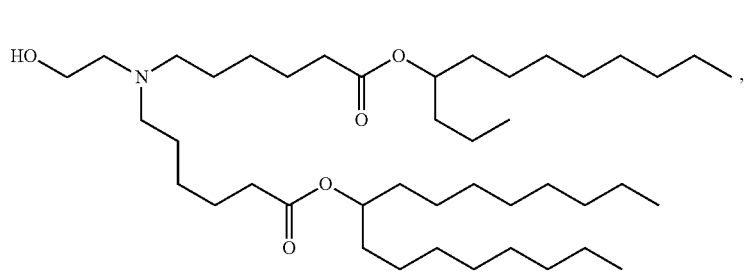
(Compound 92)
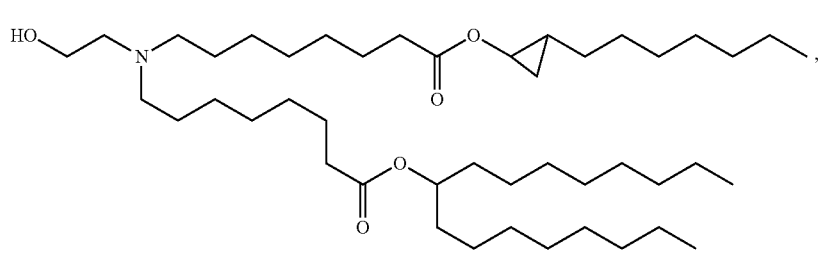
(Compound 93)
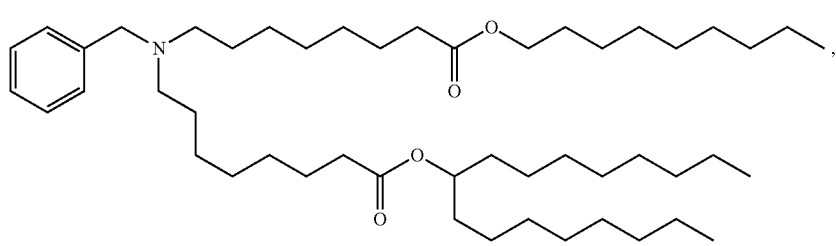
(Compound 94)

-continued
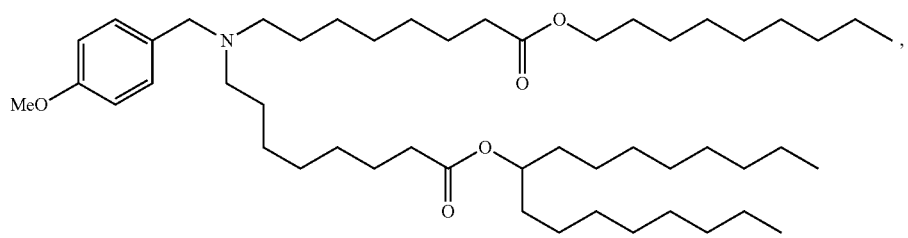
(Compound 95)
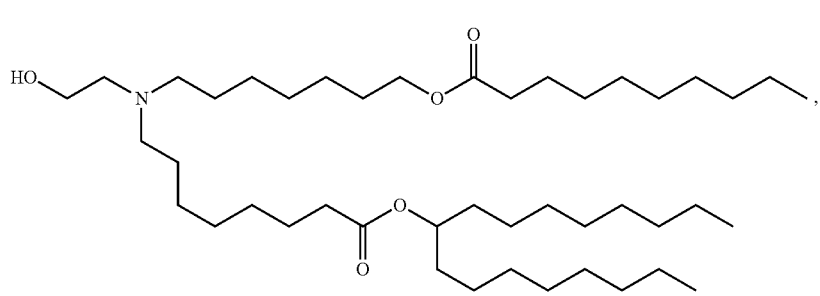
(Compound 96)
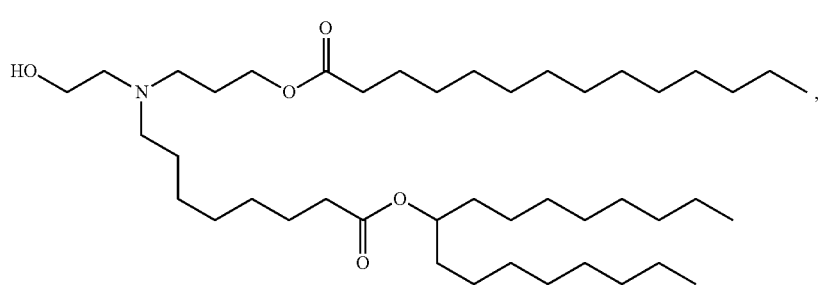
(Compound 97)
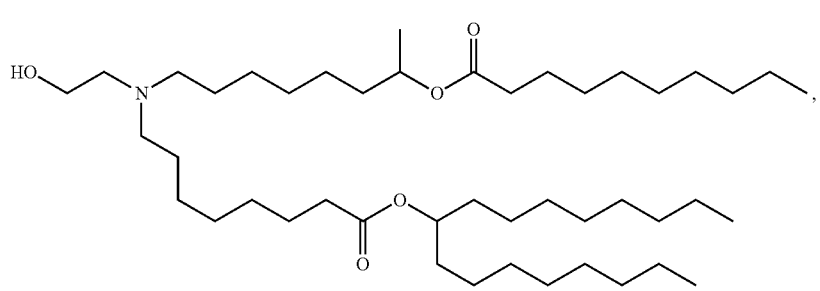
(Compound 98)
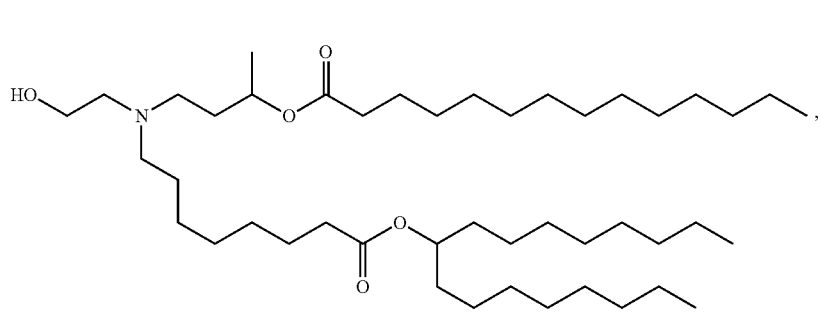
(Compound 99)

(Compound 100)
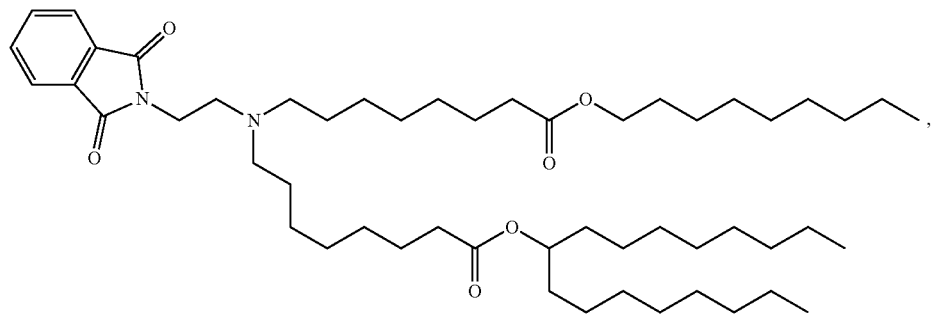
(Compound 101)
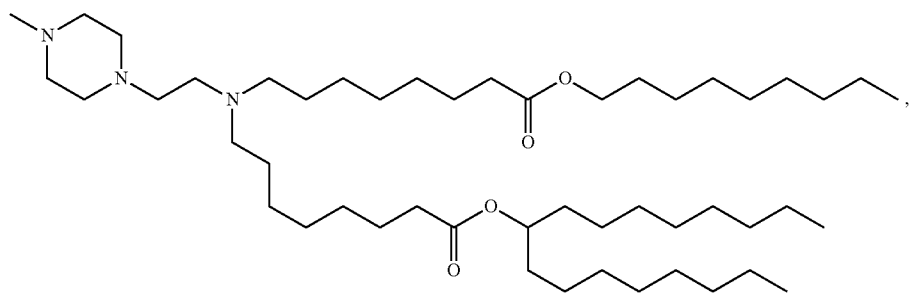
(Compound 102)
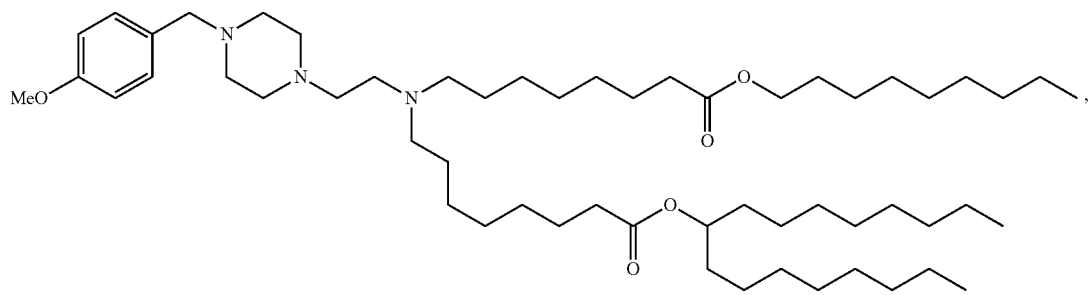
(Compound 103)
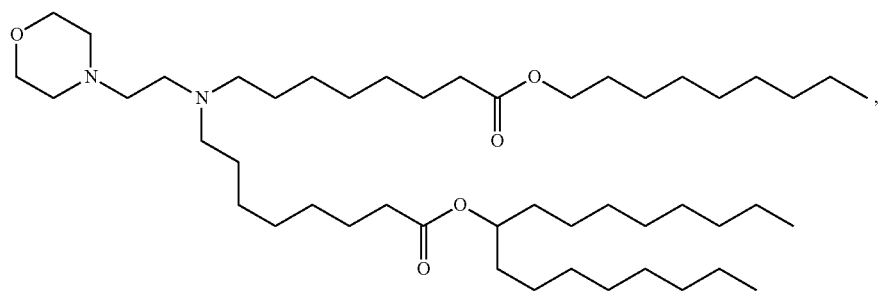
(Compound 104)
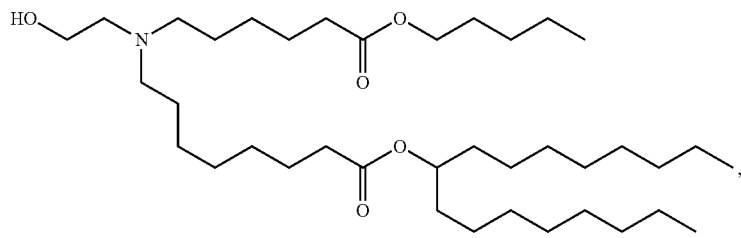

(Compound 105)
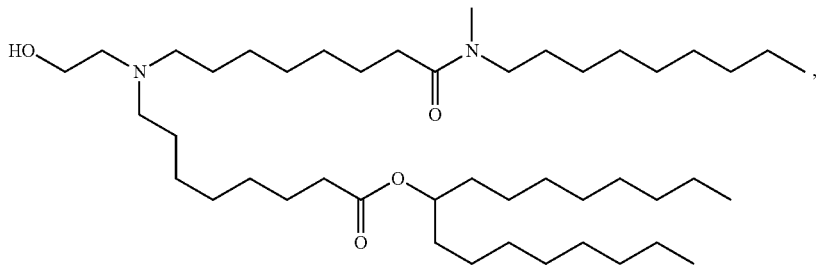
(Compound 106)
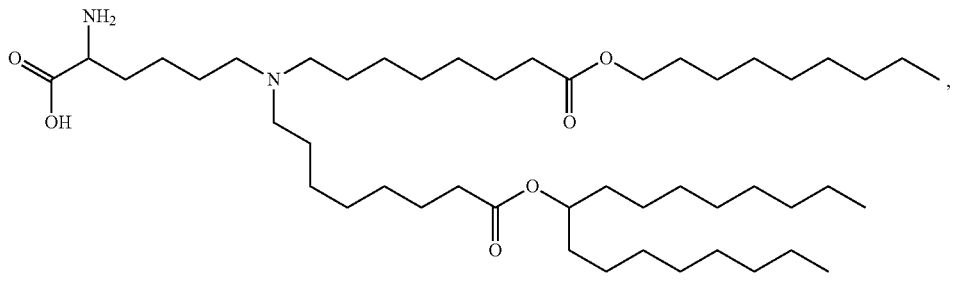
(Compound 107)
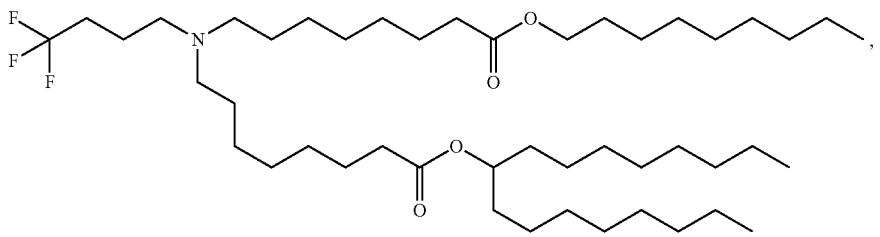
(Compound 108)
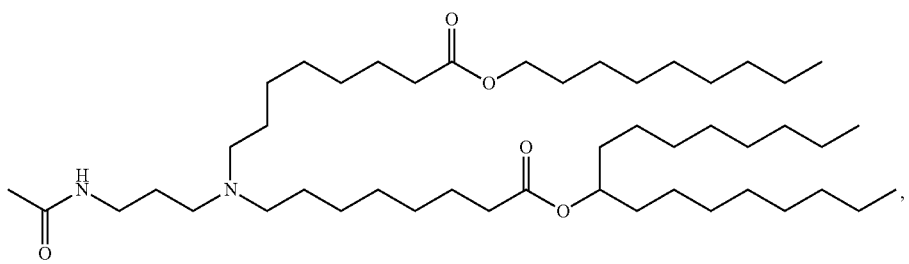
(Compound 109)
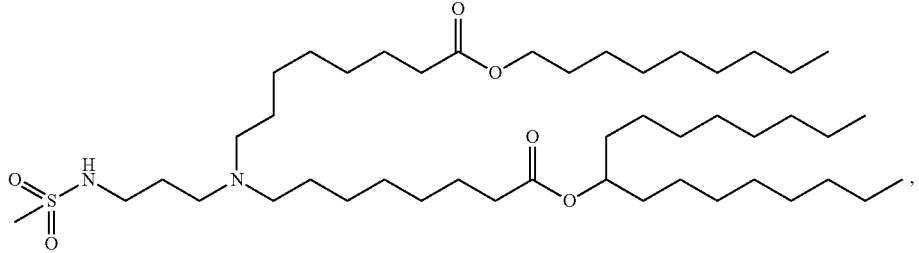
(Compound 110)
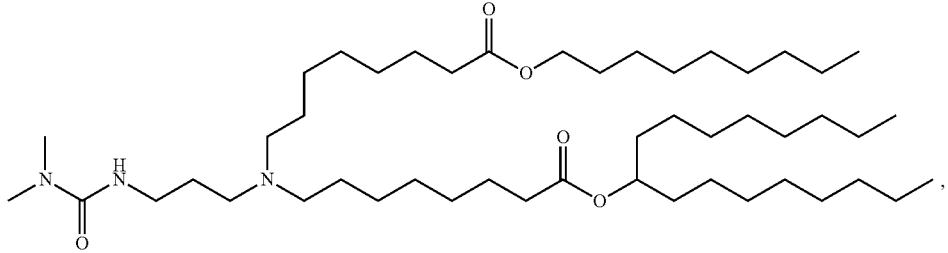

(Compound 111)
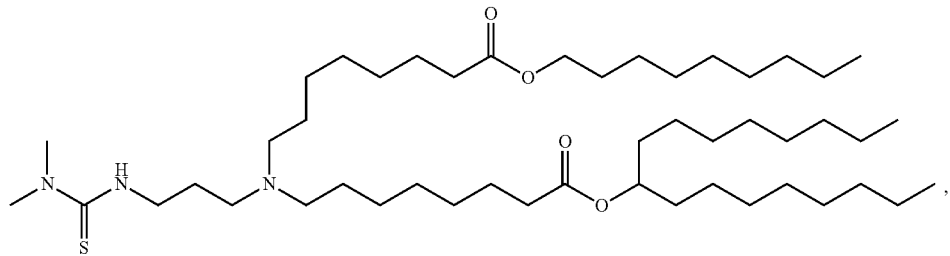
(Compound 112)
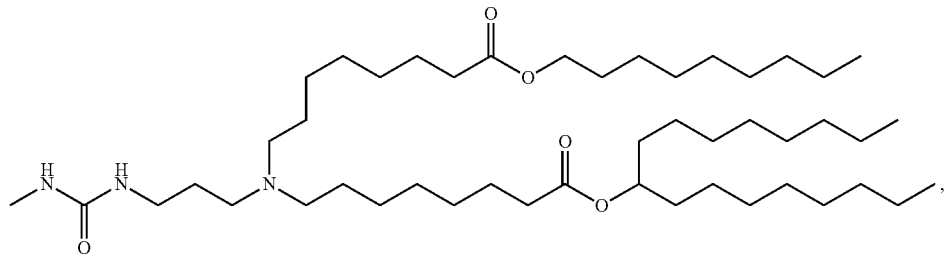
(Compound 113)
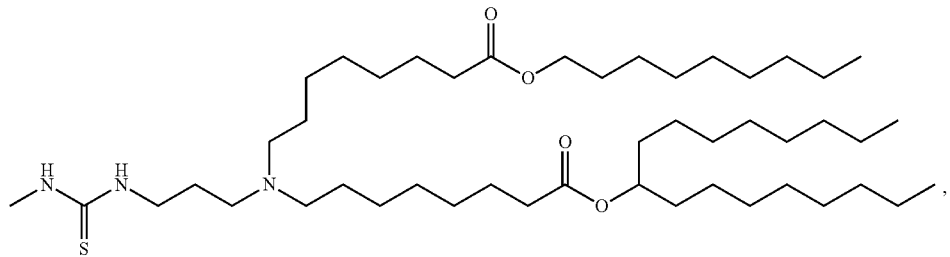
(Compound 114)
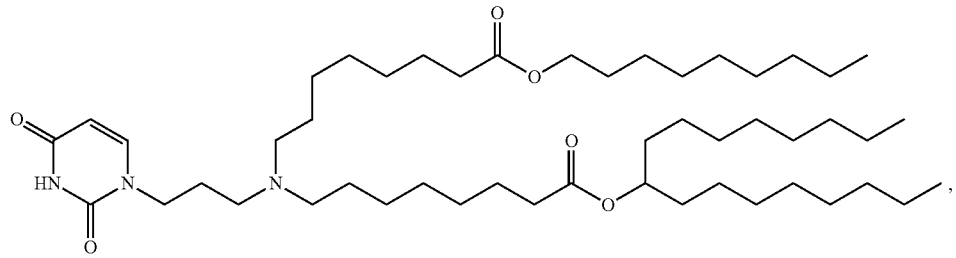
(Compound 115)
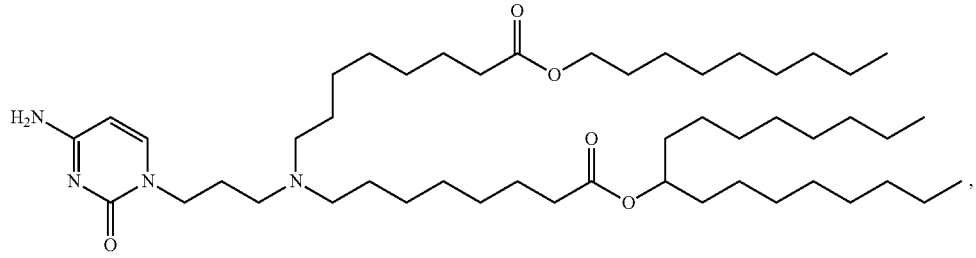
(Compound 116)
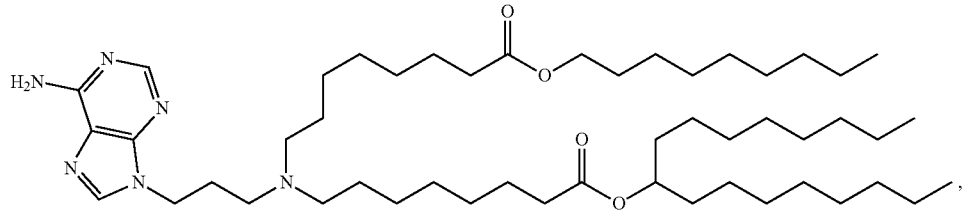

(Compound 117)
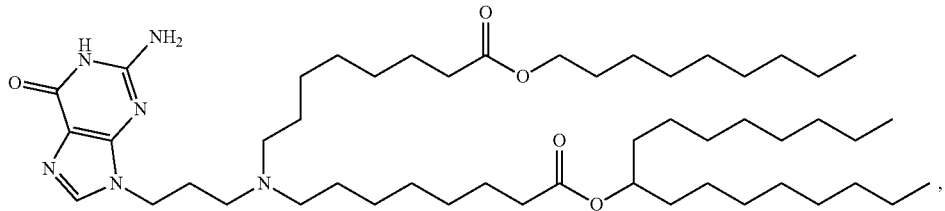
(Compound 118)
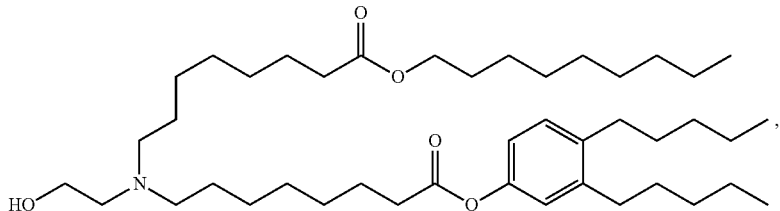
(Compound 119)
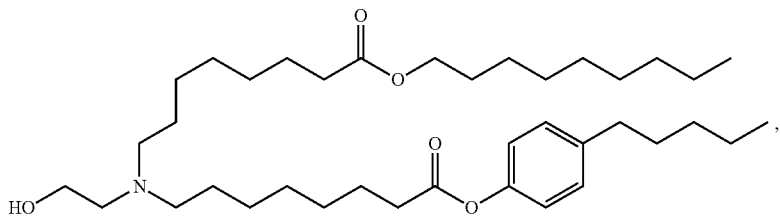
(Compound 120)
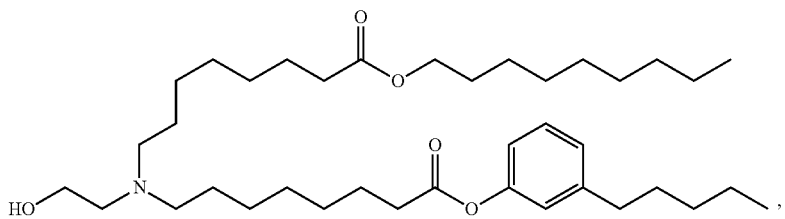
(Compound 121)
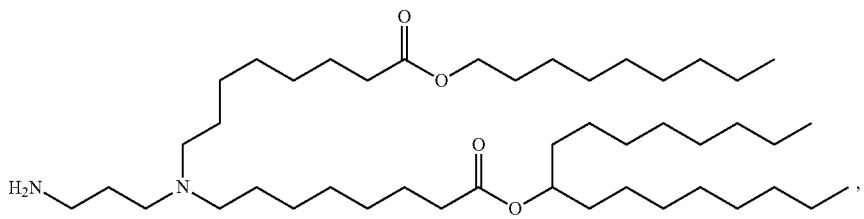
(Compound 122)
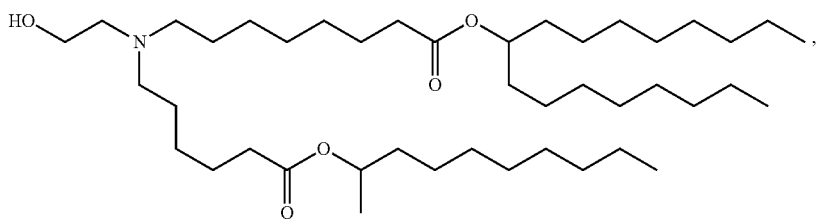
(Compound 123)
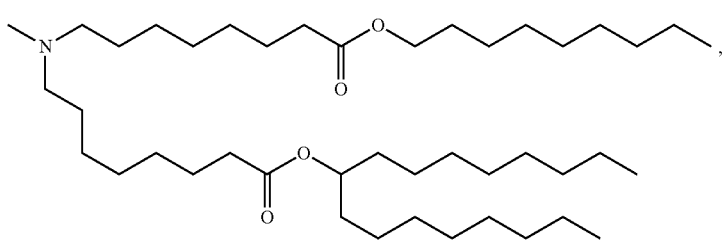

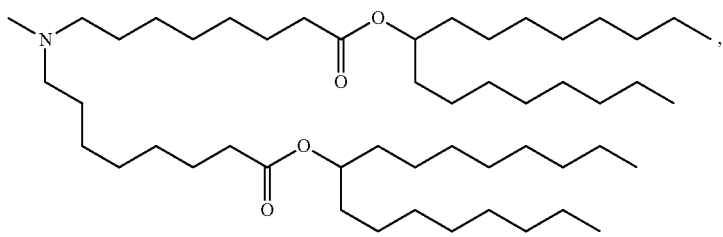
(Compound 124)
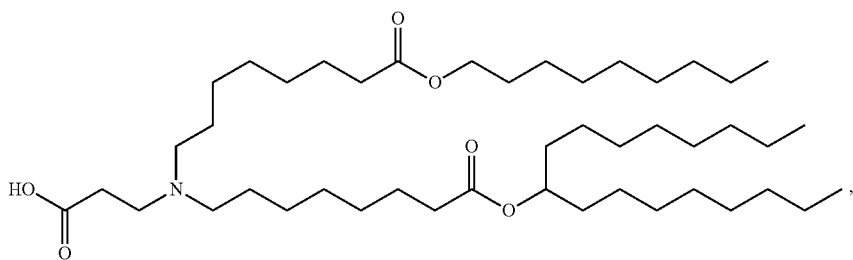
(Compound 125)
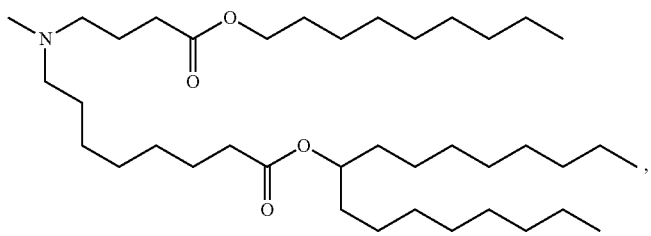
(Compound 126)
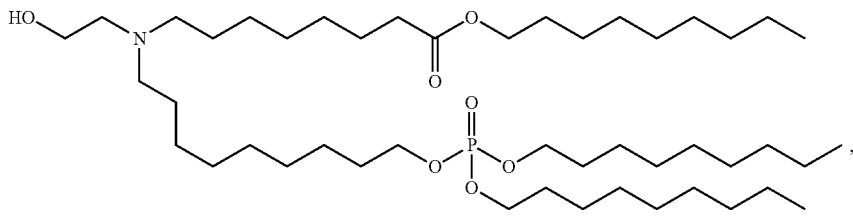
(Compound 127)
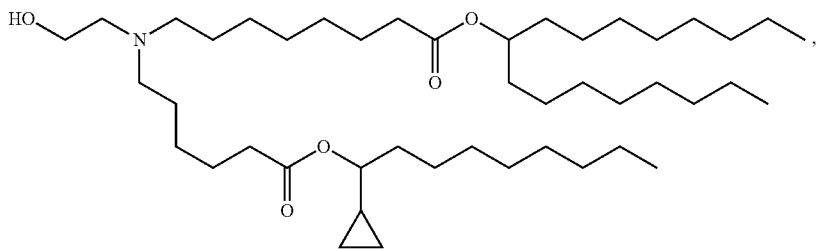
(Compound 128)
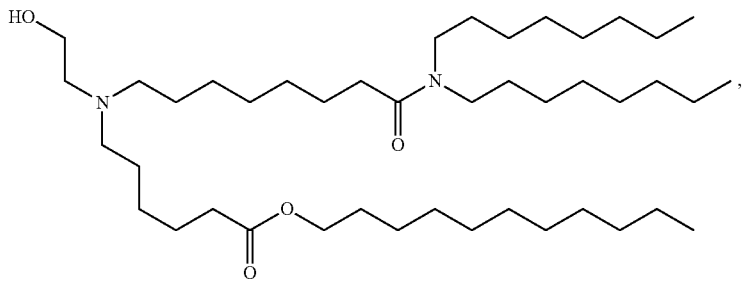
(Compound 129)

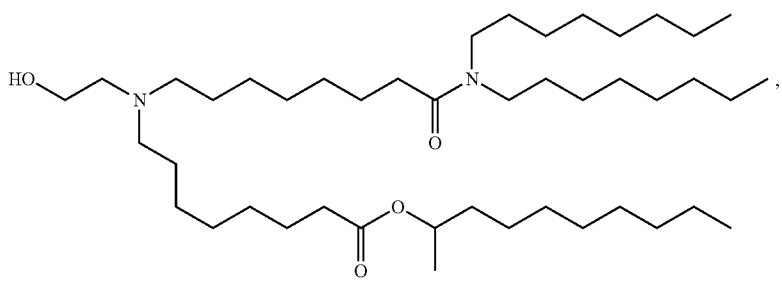
(Compound 130)
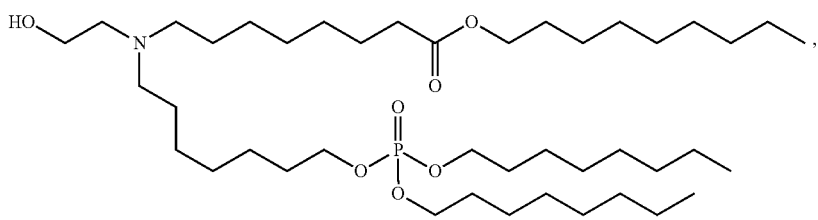
(Compound 131)
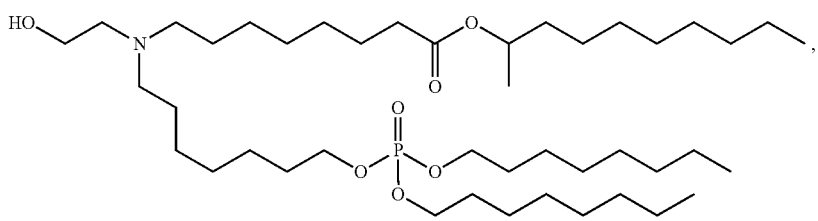
(Compound 132)
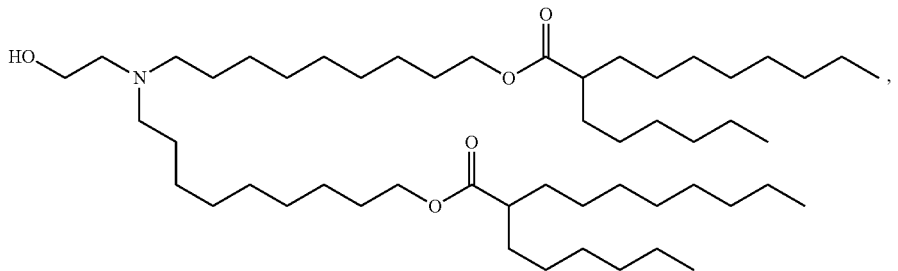
(Compound 133)
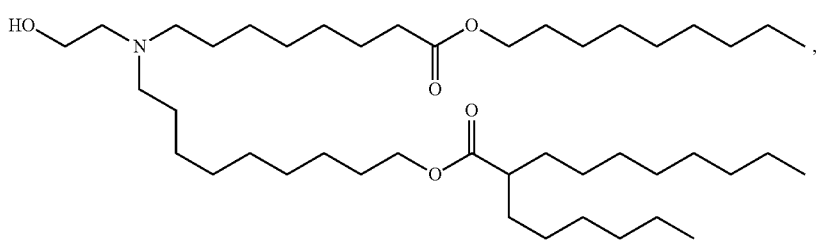
(Compound 134)
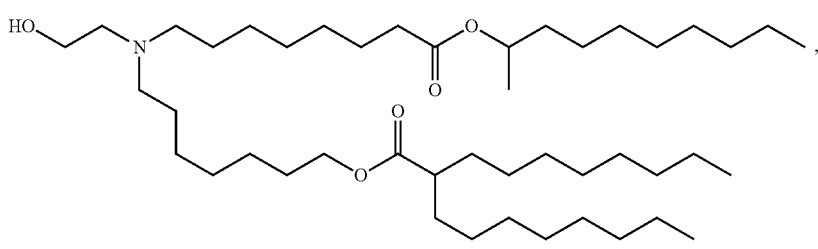
(Compound 135)

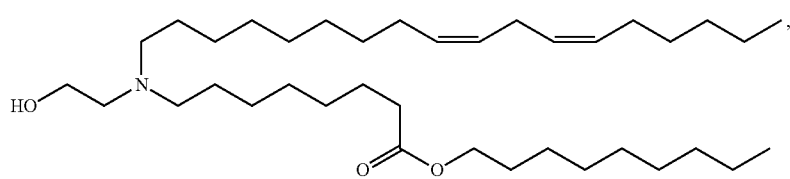
(Compound 136)
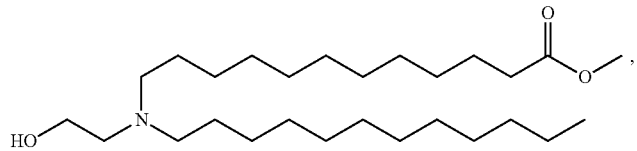
(Compound 137)
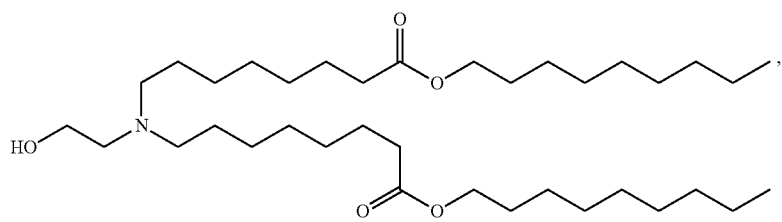
(Compound 138)
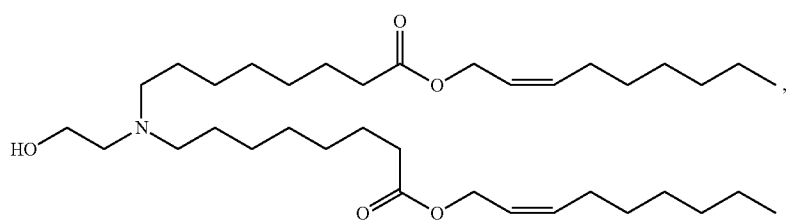
(Compound 139)
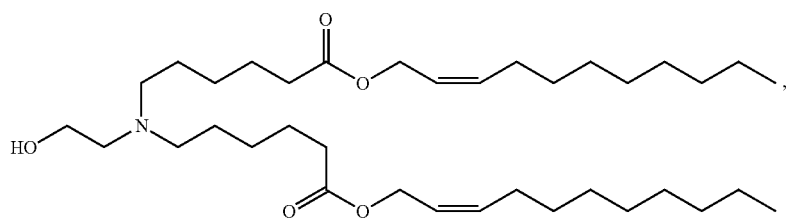
(Compound 140)
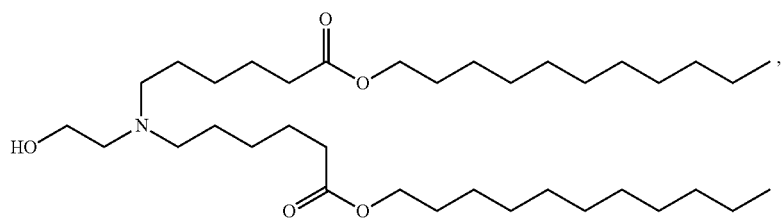
(Compound 141)
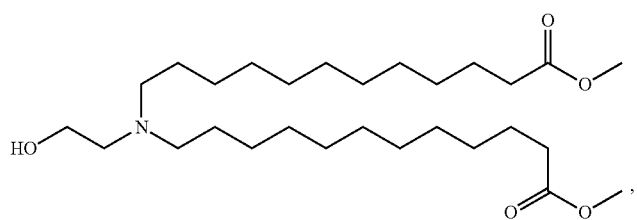
(Compound 142)

(Compound 143)
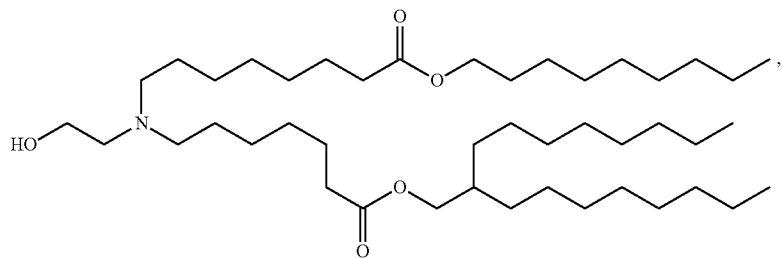
(Compound 144)
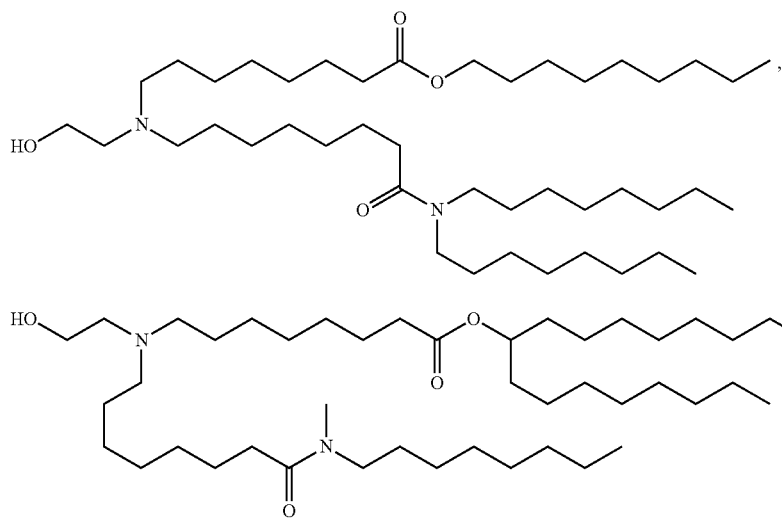
(Compound 145)
(Compound 146)
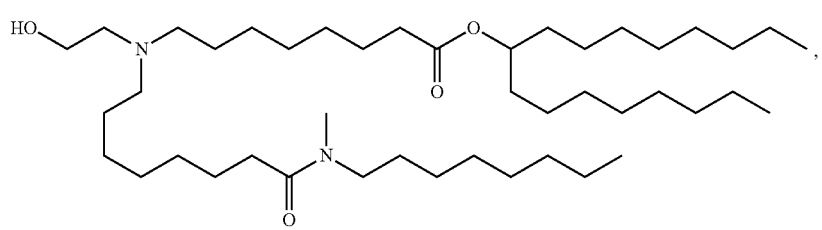
(Compound 147)
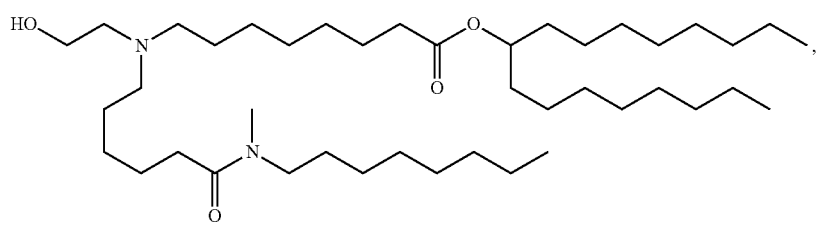
(Compound 148)
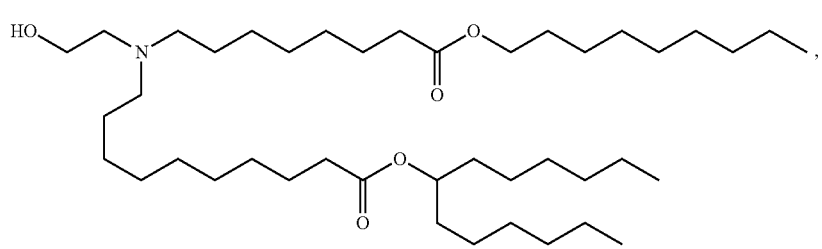
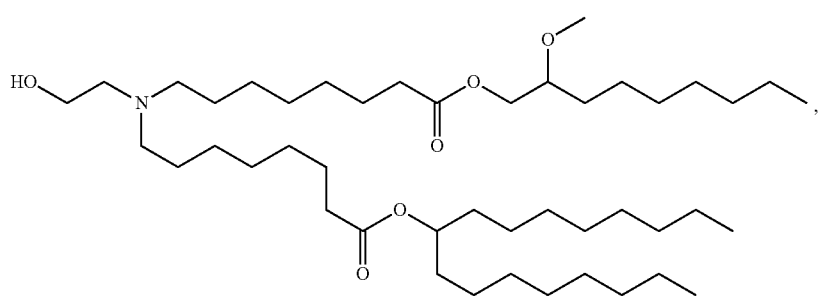

-continued
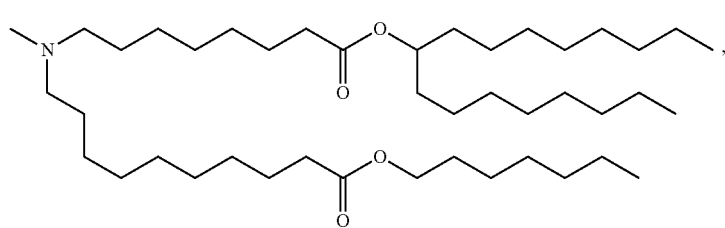
(Compound 149)
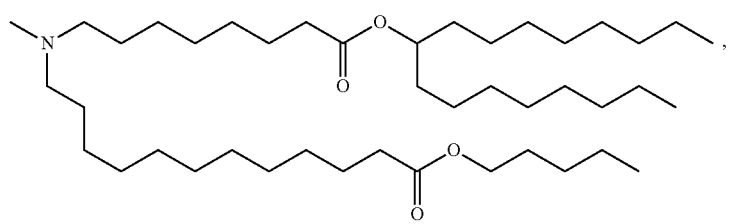
(Compound 150)
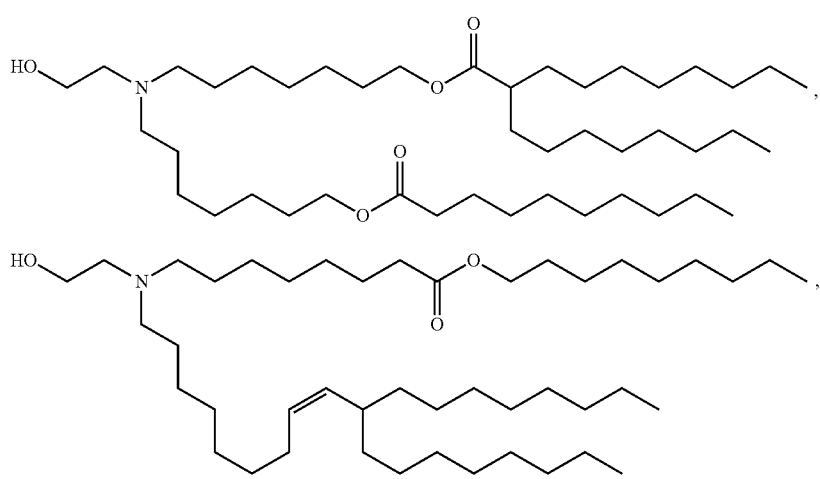
(Compound 151)
(Compound 152)
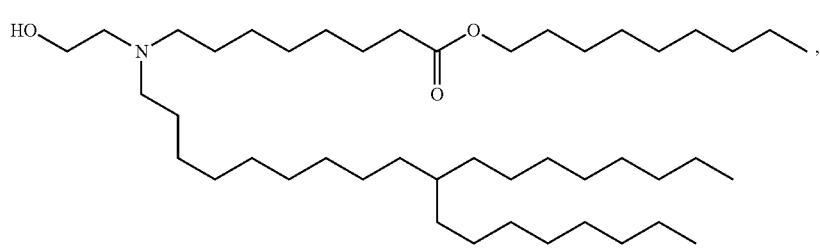
(Compound 153)
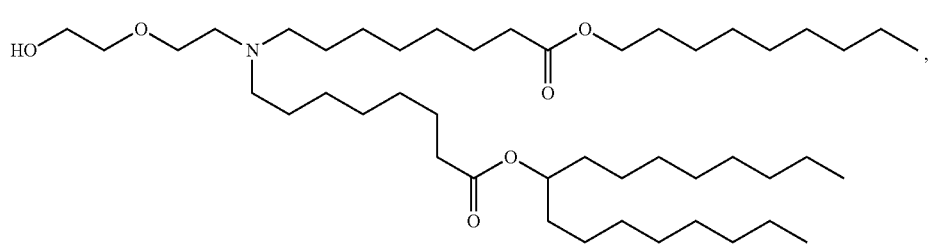
(Compound 154)
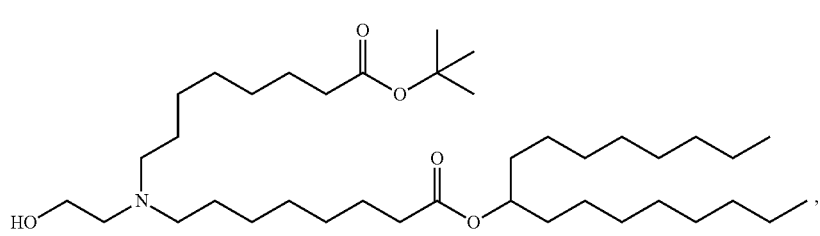
(Compound 155)

-continued
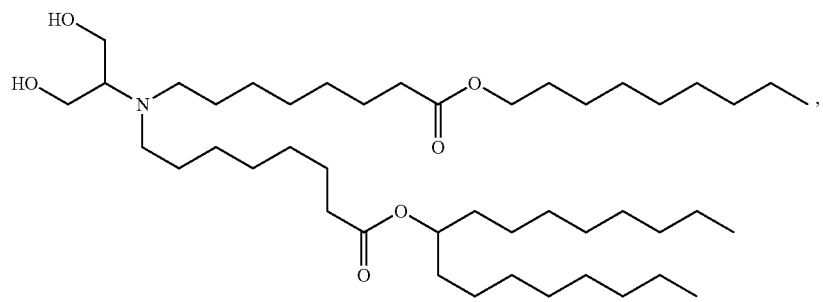
(Compound 156)
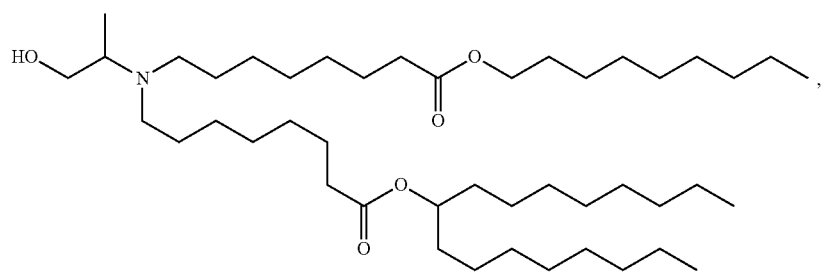
(Compound 157)
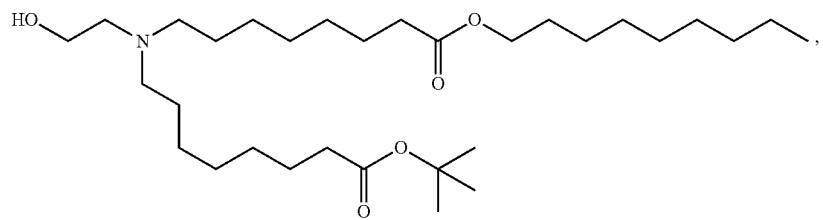
(Compound 158)
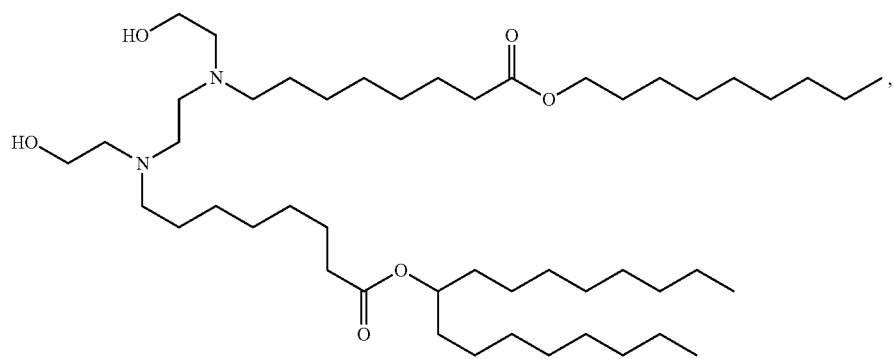
(Compound 159)

-continued
(Compound 160)
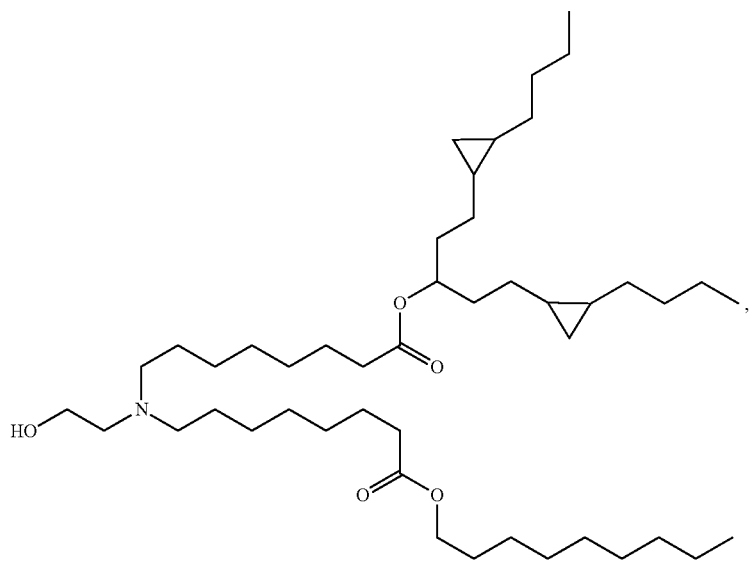
(Compound 161)
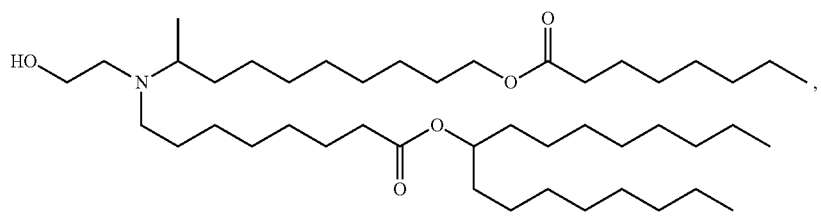
(Compound 162)
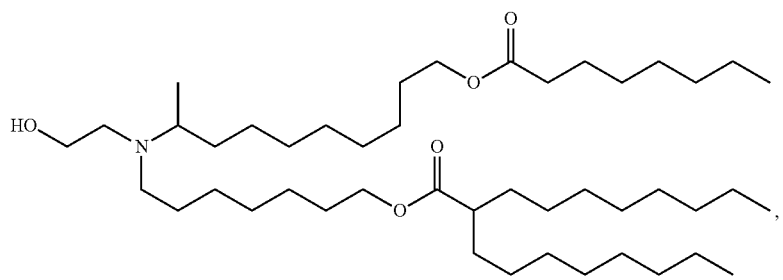
(Compound 163)
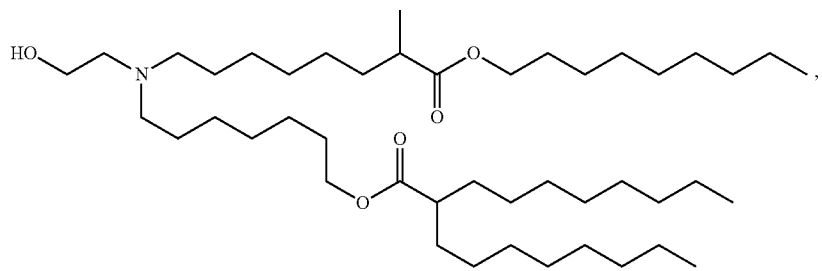
(Compound 164)
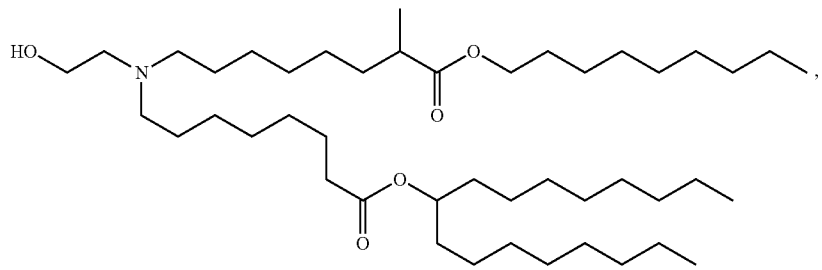

(Compound 165)
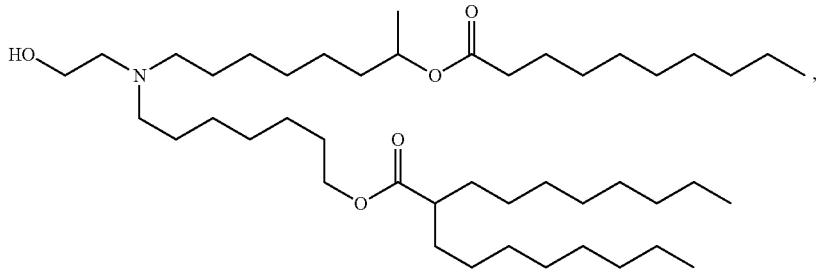
(Compound 166)
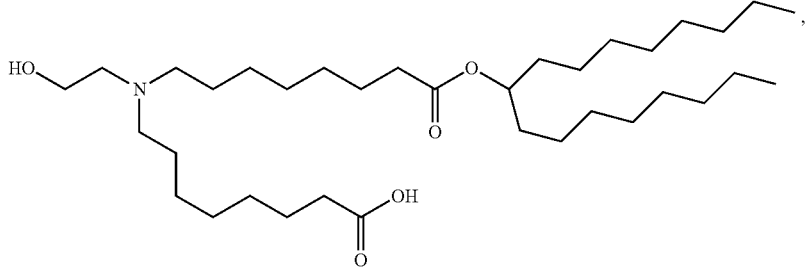
(Compound 167)
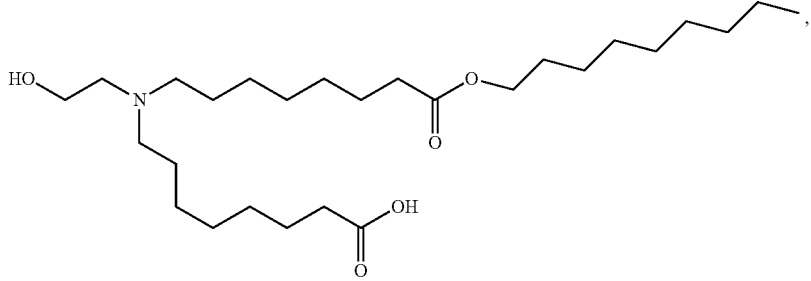
(Compound 168)
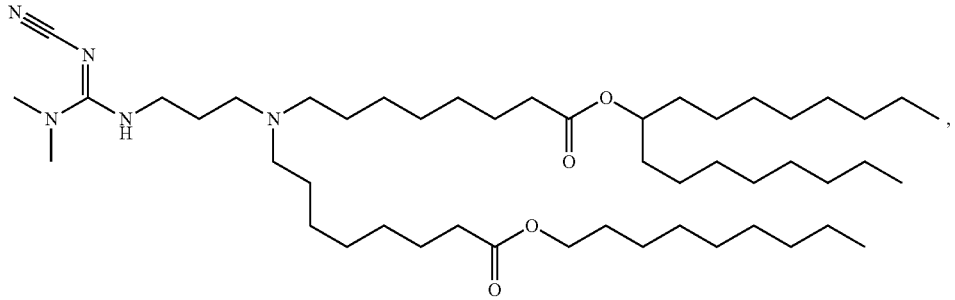
(Compound 169)
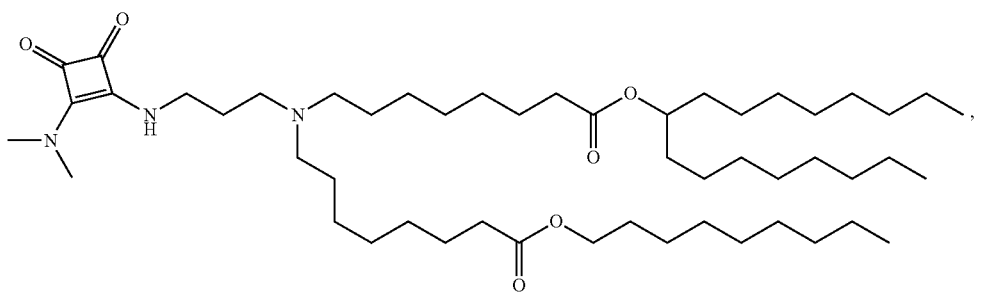

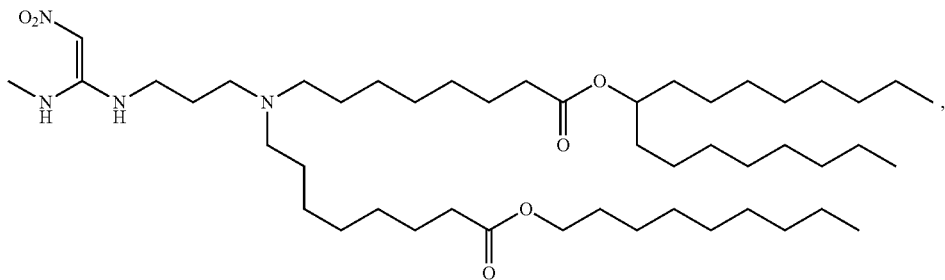
(Compound 170)
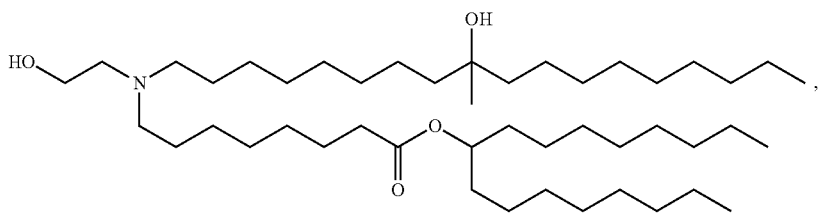
(Compound 171)
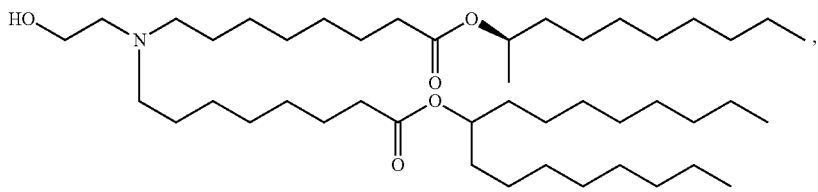
(Compound 172)
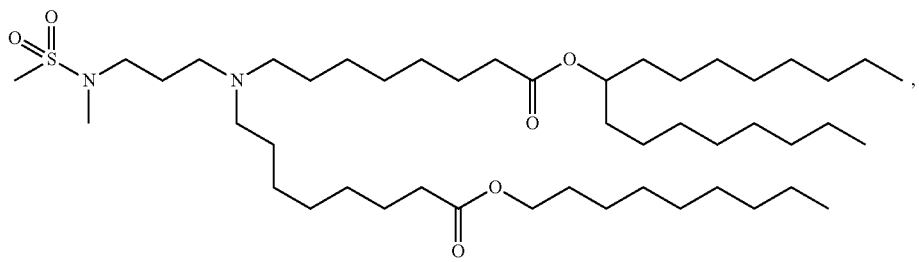
(Compound 173)
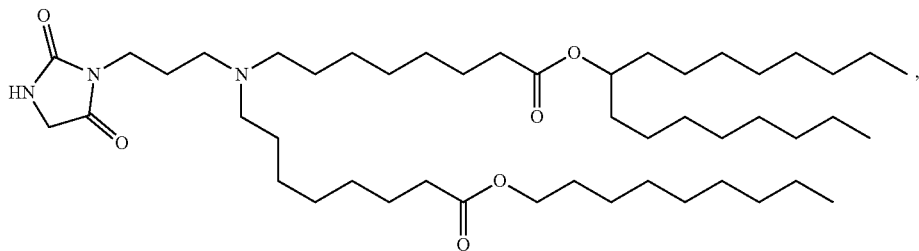
(Compound 174)
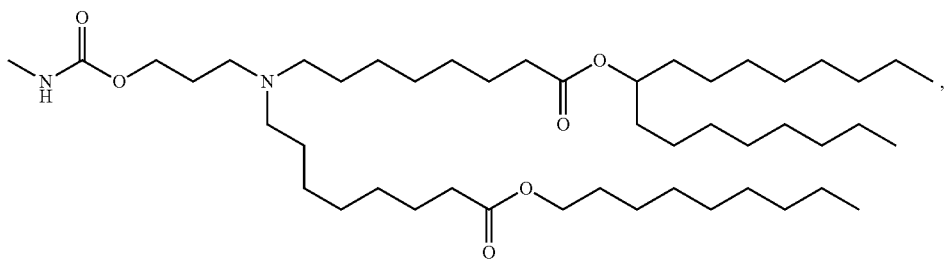
(Compound 175)

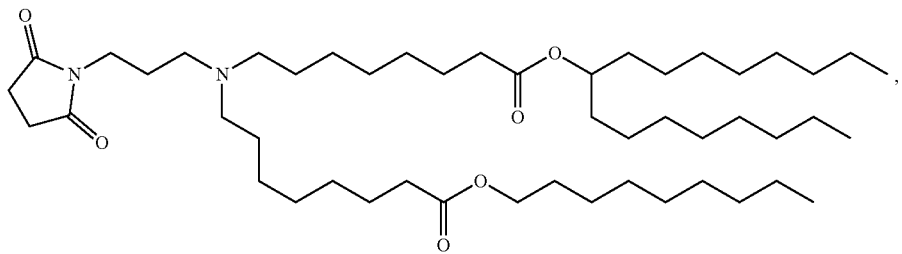
(Compound 176)
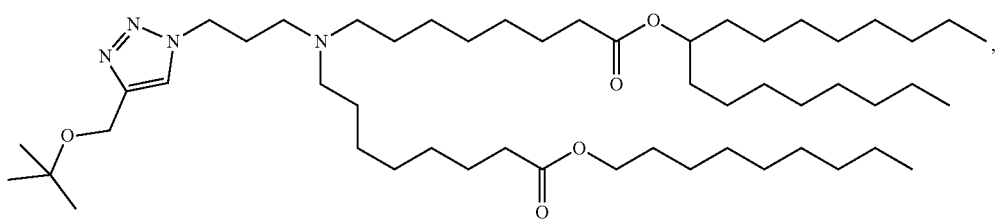
(Compound 177)
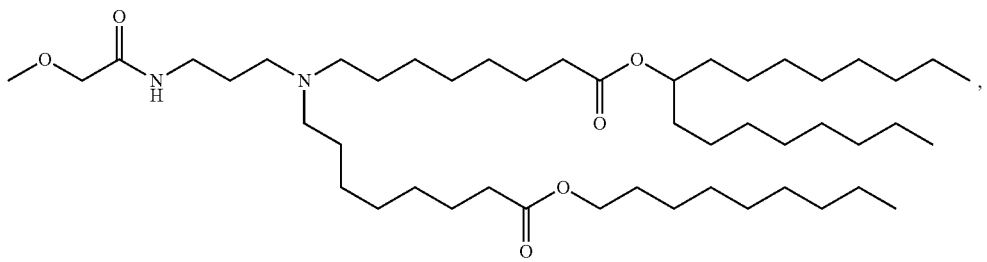
(Compound 178)
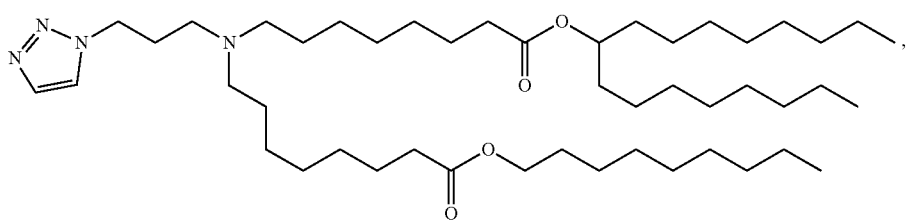
(Compound 179)
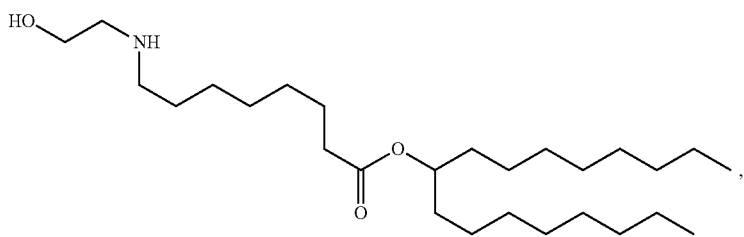
(Compound 180)
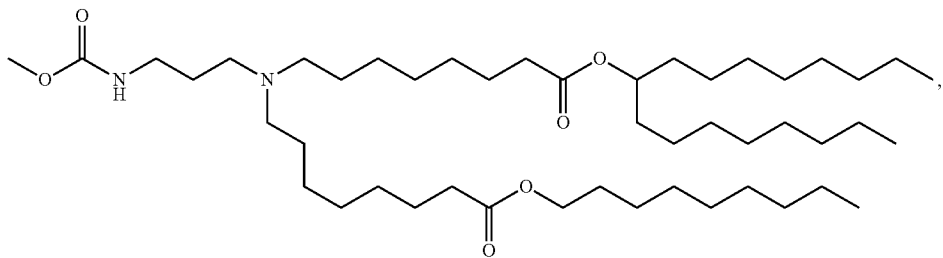
(Compound 181)

(Compound 182)
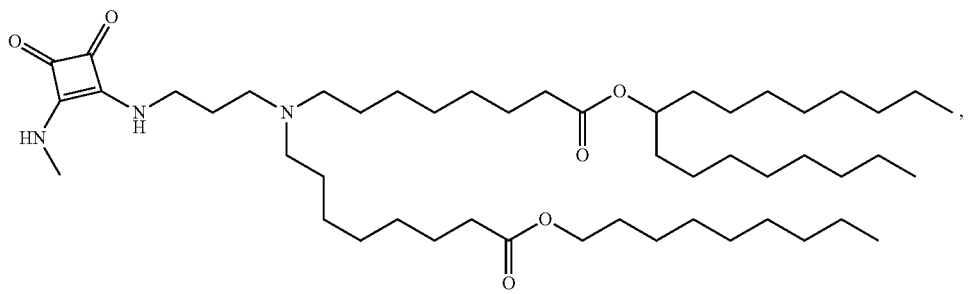
(Compound 183)
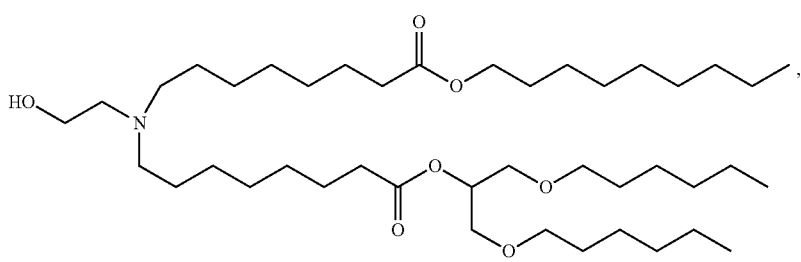
(Compound 184)
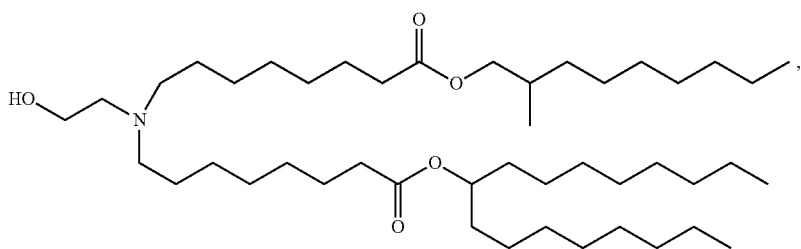
(Compound 185)
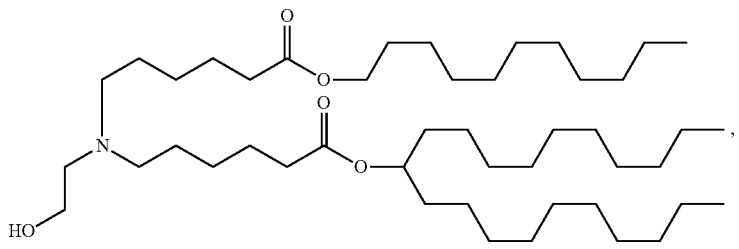
(Compound 186)
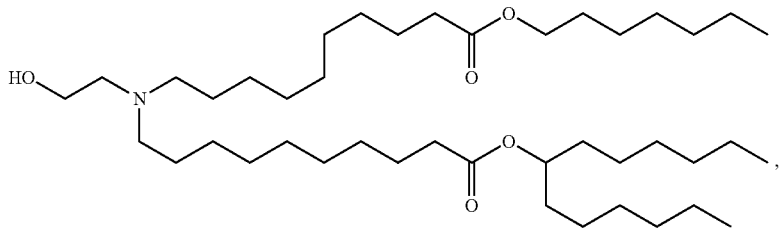
(Compound 187)
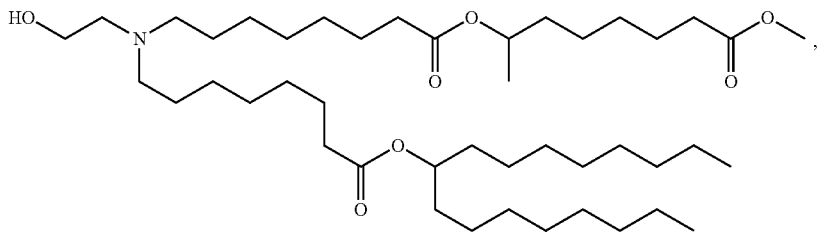

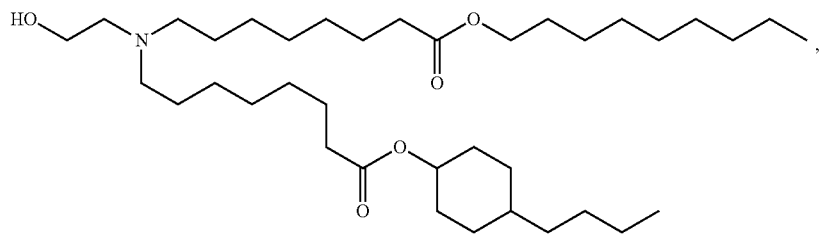
(Compound 188)
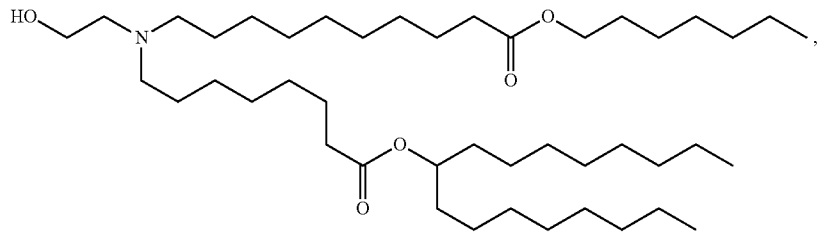
(Compound 189)
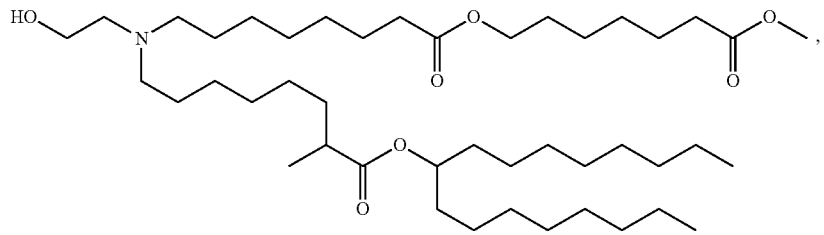
(Compound 190)
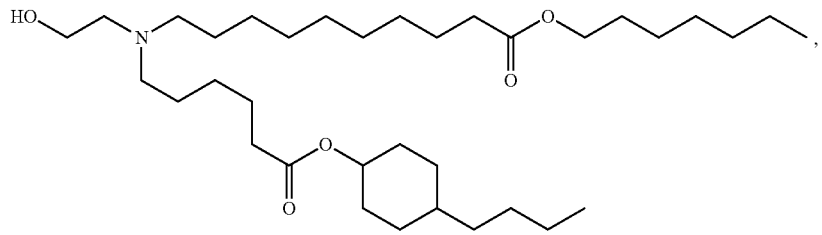
(Compound 191)
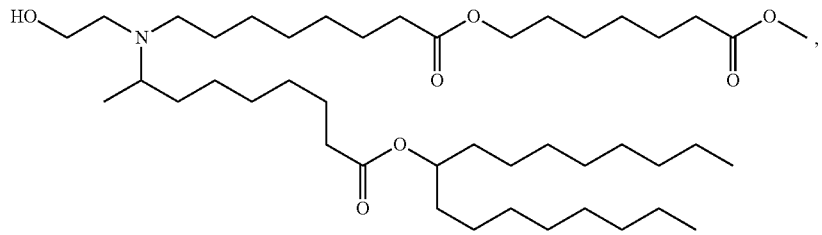
(Compound 192)
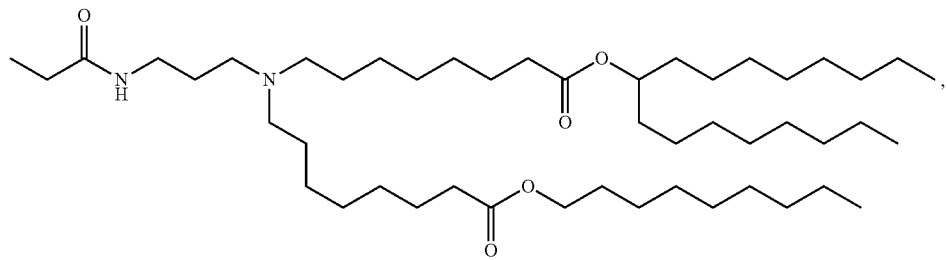
(Compound 193)

-continued
(Compound 194)
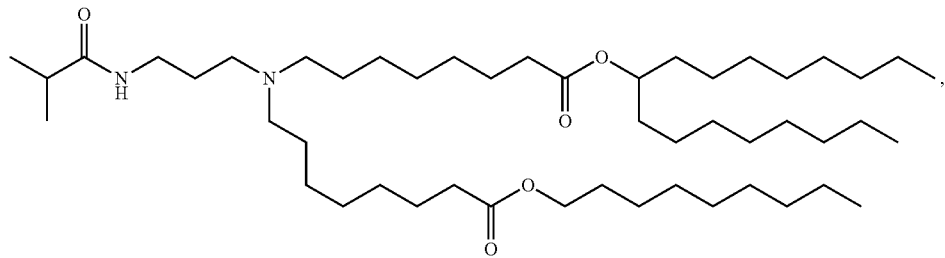
(Compound 195)
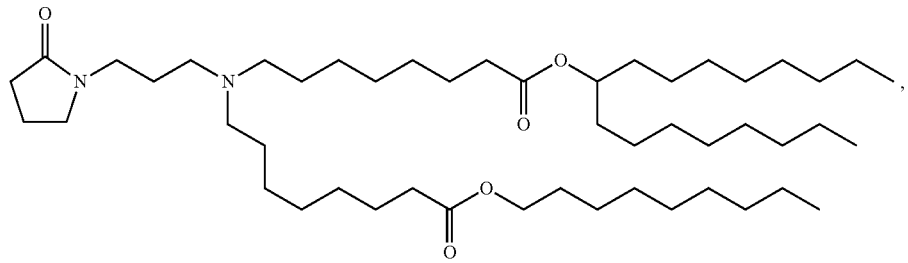
(Compound 196)
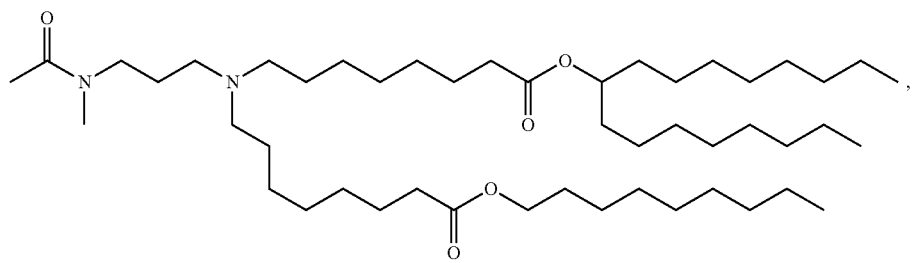
(Compound 197)
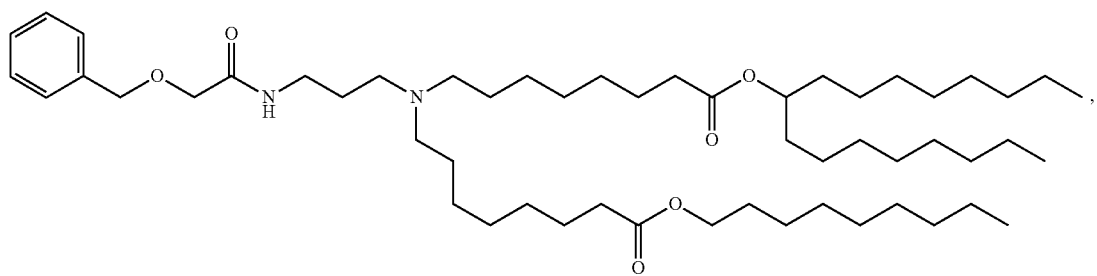
(Compound 198)
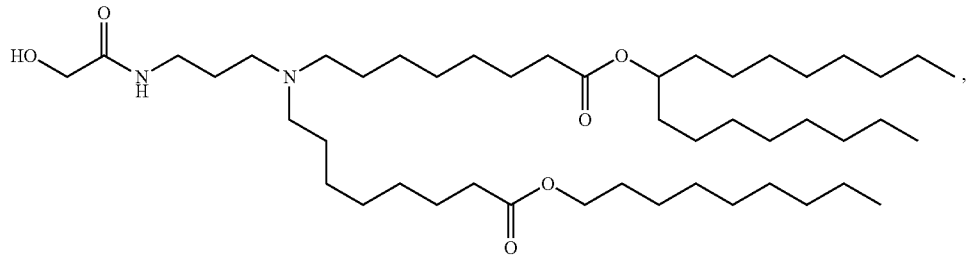
(Compound 199)
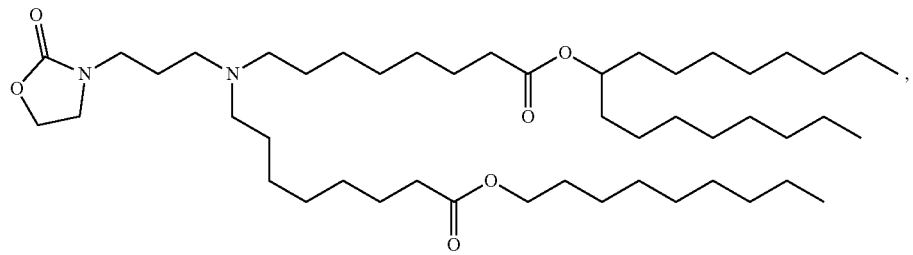

(Compound 200)
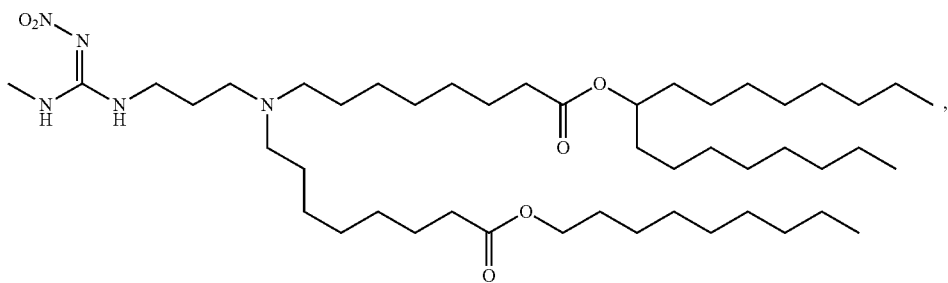
(Compound 201)
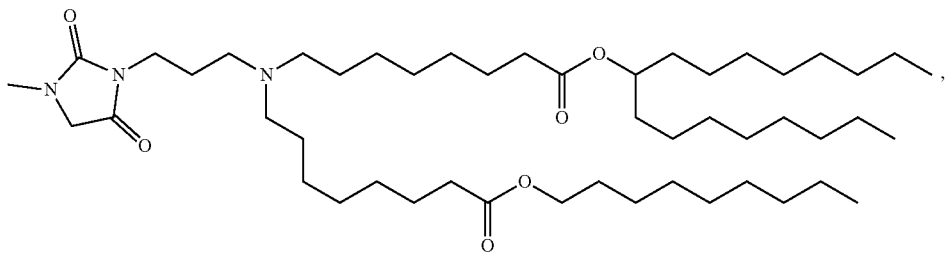
(Compound 202)
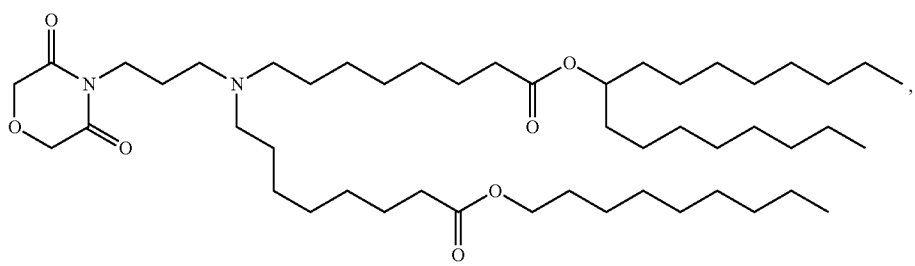
(Compound 203)
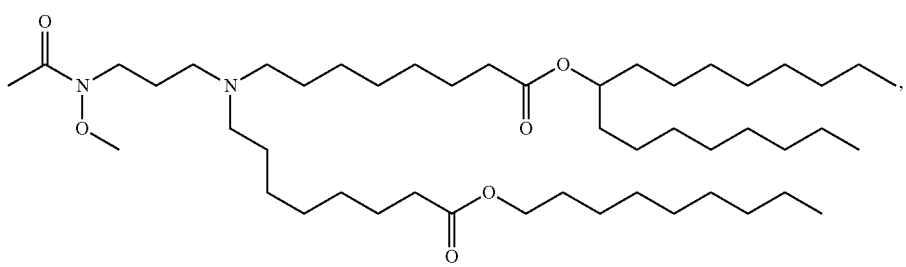
(Compound 204)
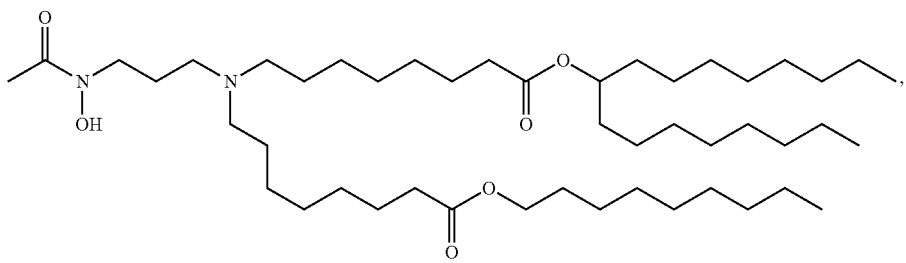
(Compound 205)
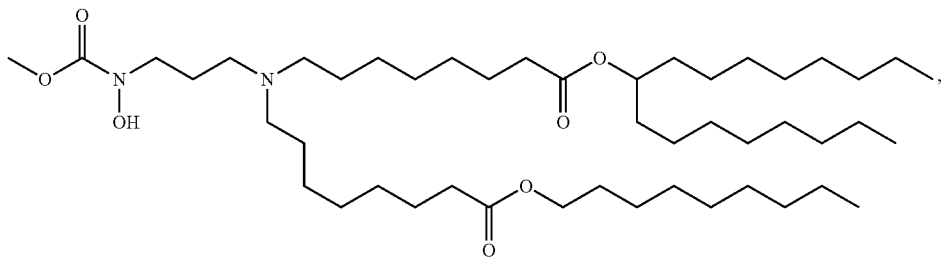

-continued
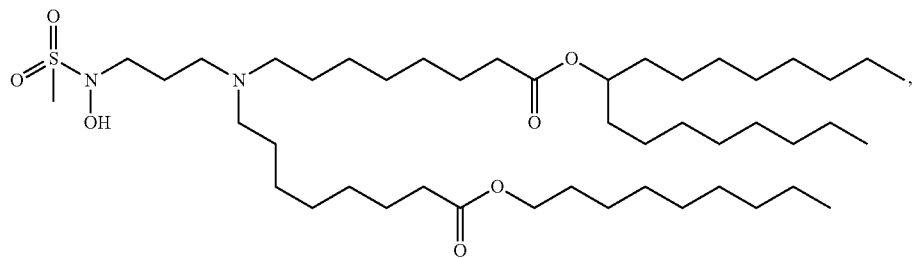
(Compound 206)
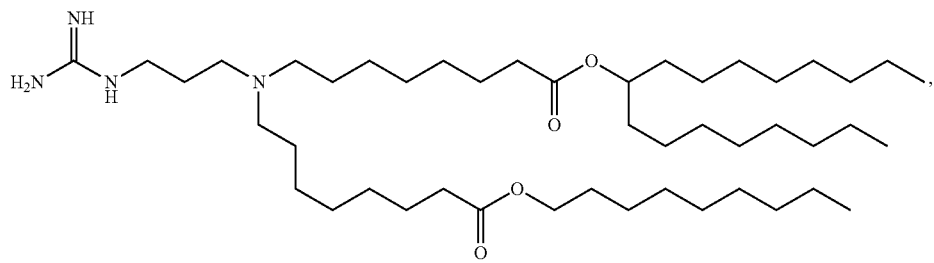
(Compound 207)
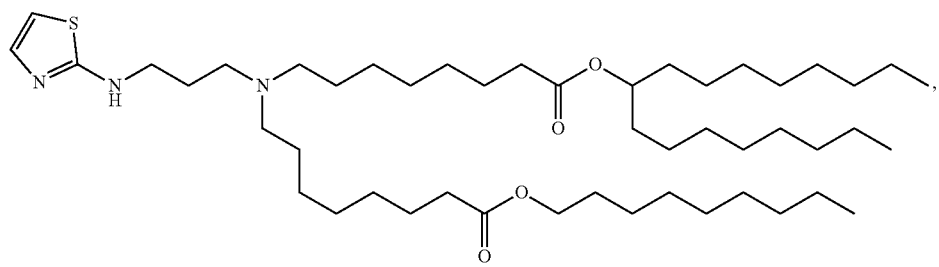
(Compound 208)
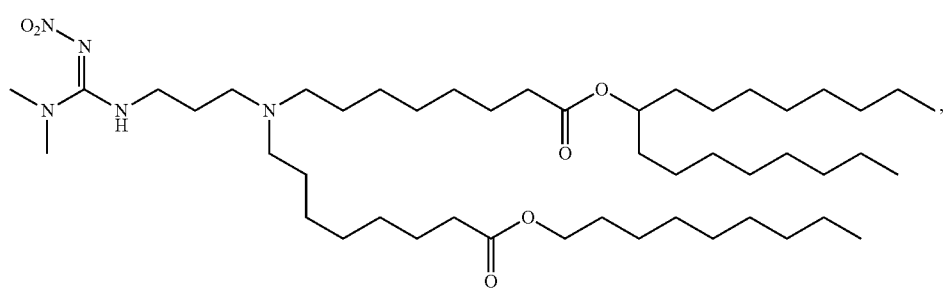
(Compound 209)
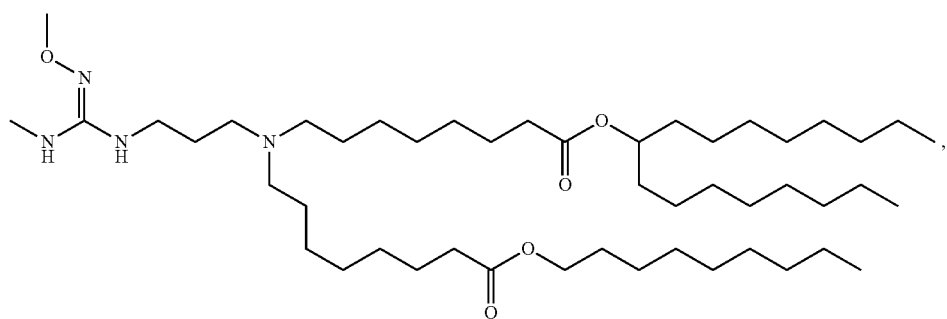
(Compound 210)

-continued
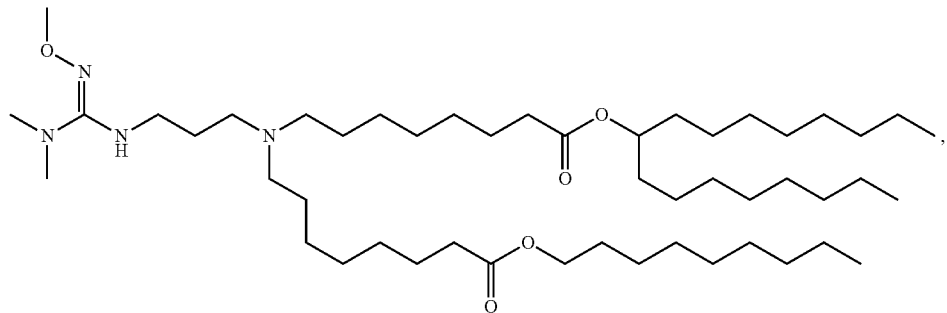
(Compound 211)
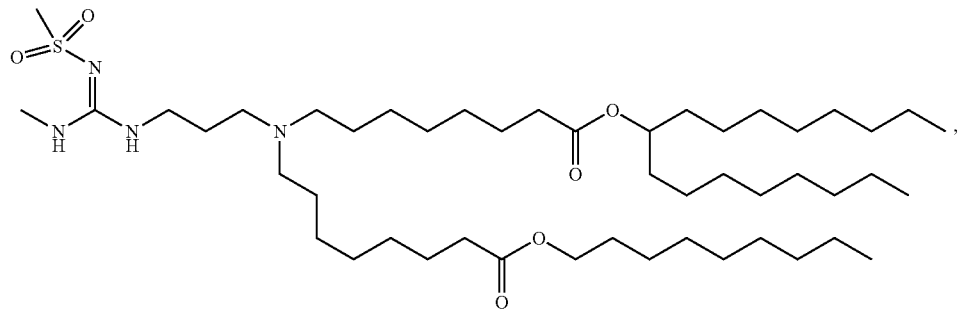
(Compound 212)
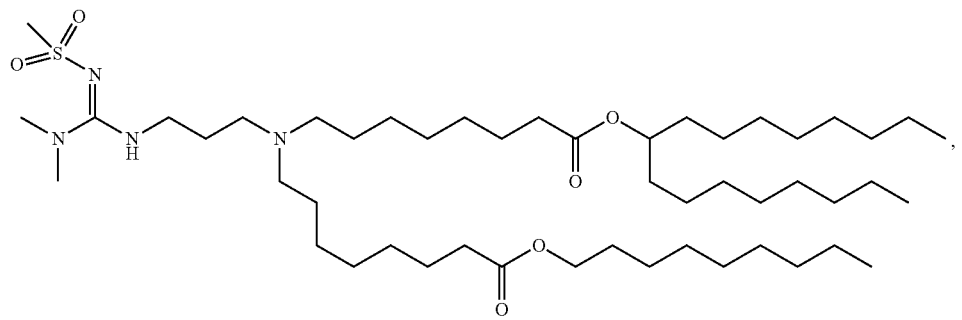
(Compound 213)
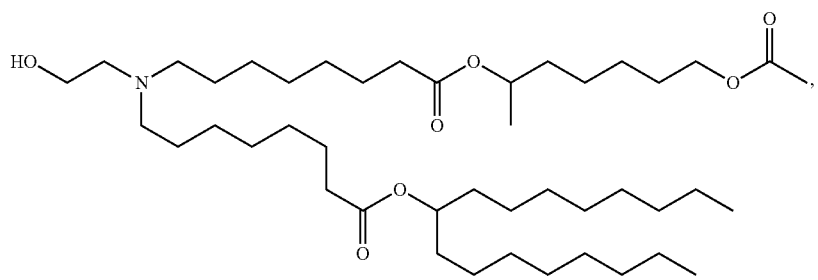
(Compound 214)
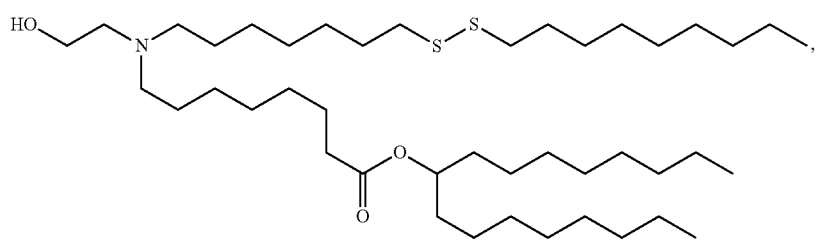
(Compound 215)

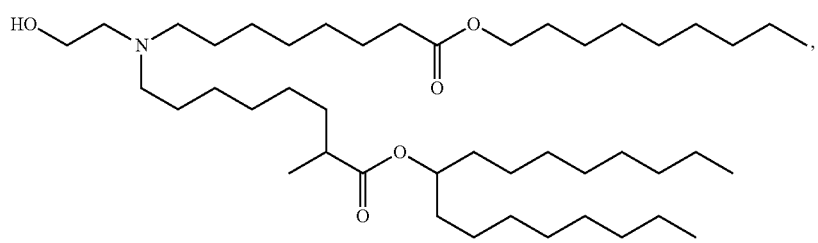
(Compound 216)
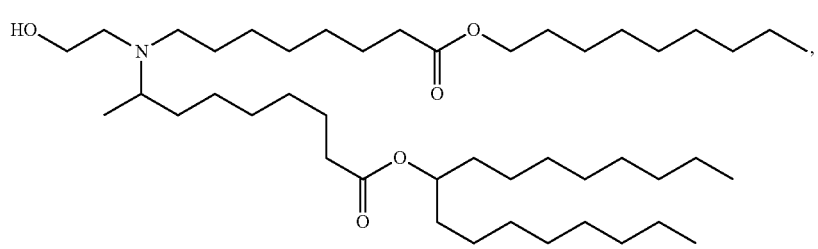
(Compound 217)
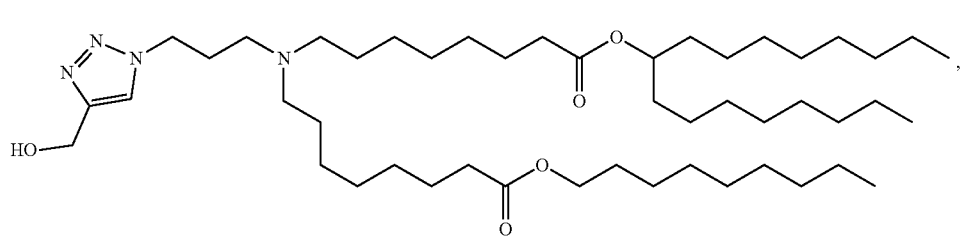
(Compound 218)
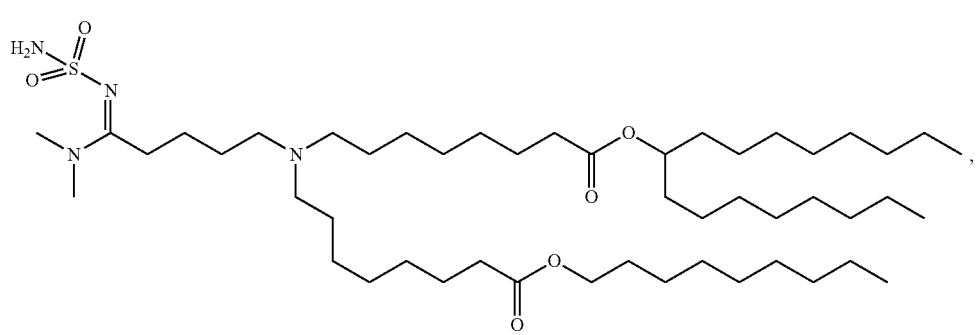
(Compound 219)
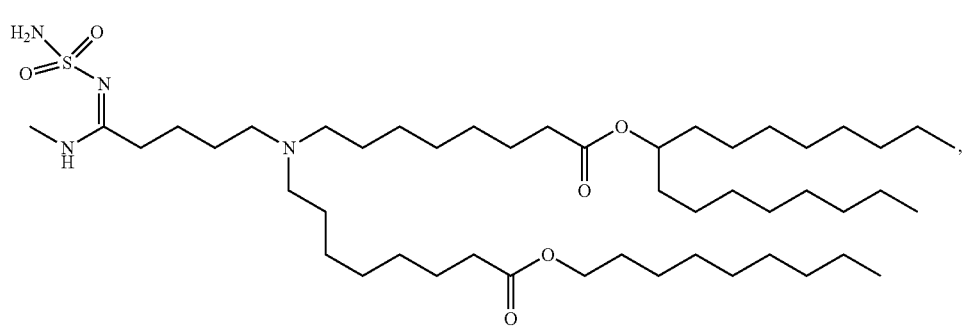
(Compound 220)

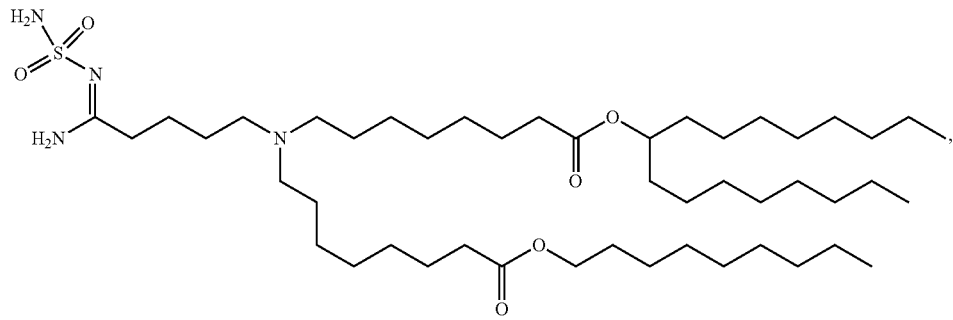
(Compound 221)
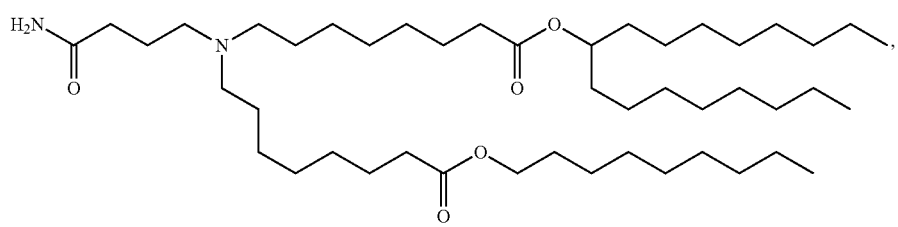
(Compound 222)
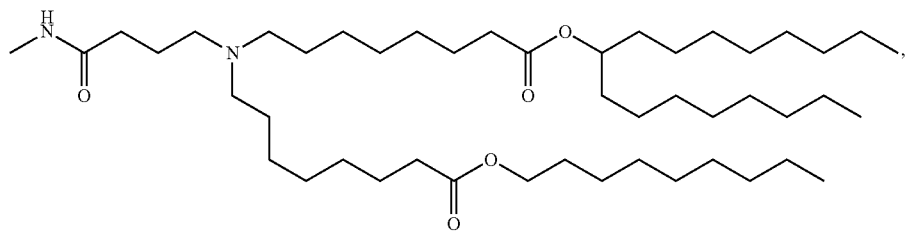
(Compound 223)
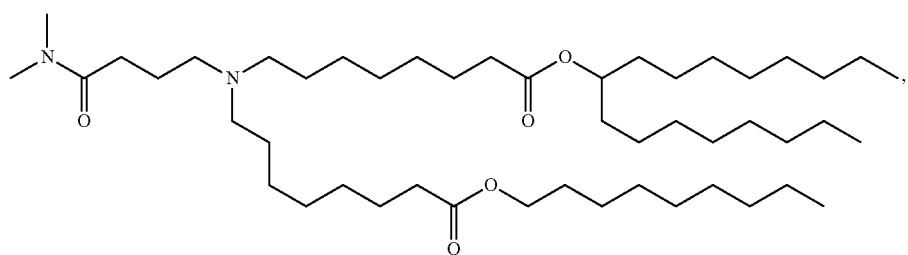
(Compound 224)
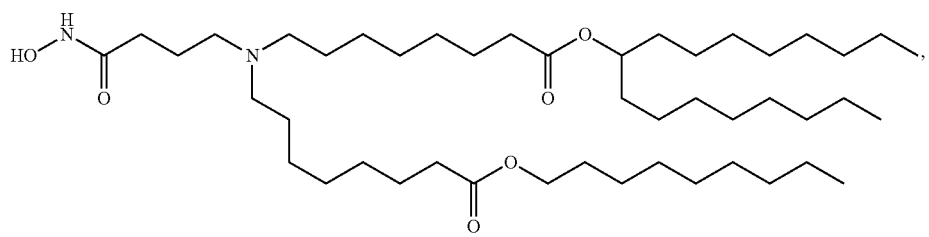
(Compound 225)
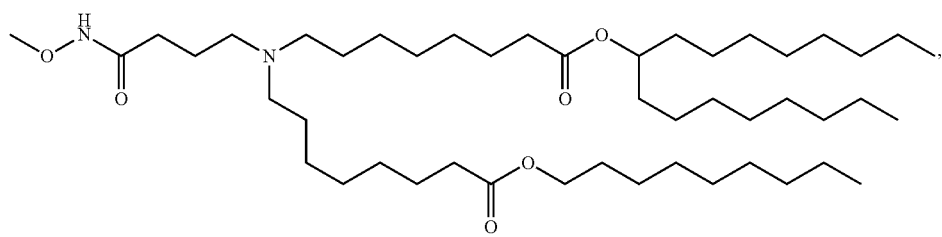
(Compound 226)

-continued
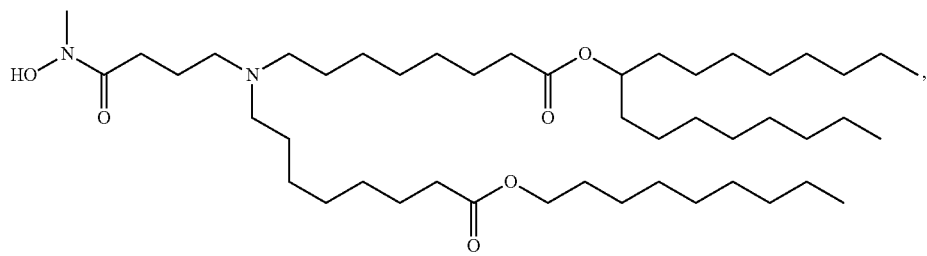
(Compound 227)
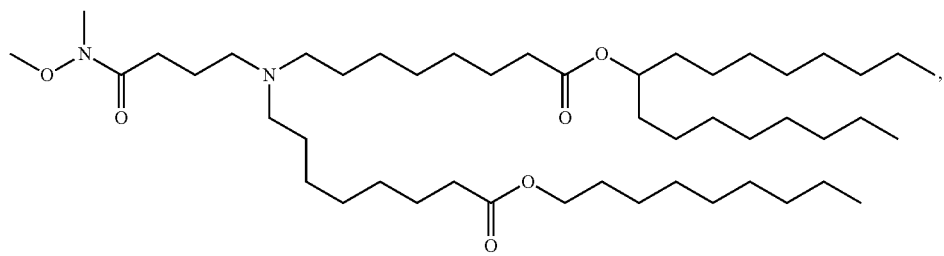
(Compound 228)
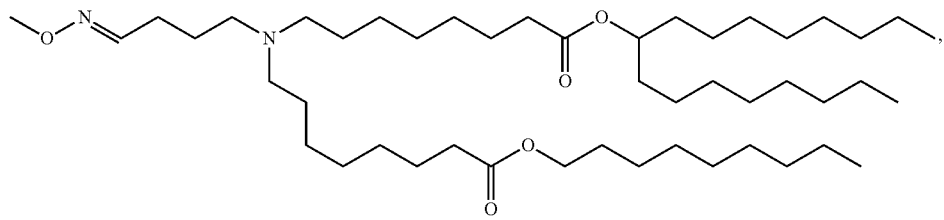
(Compound 29)
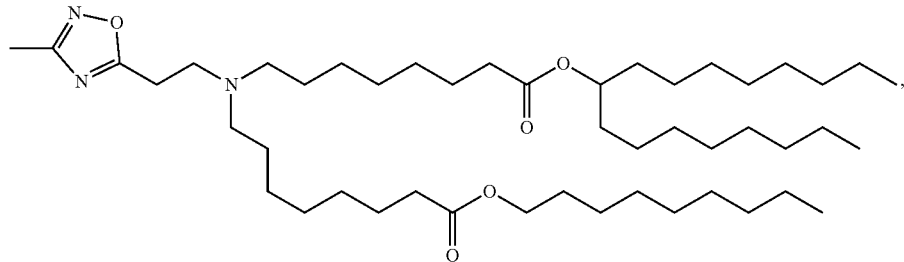
(Compound 230)
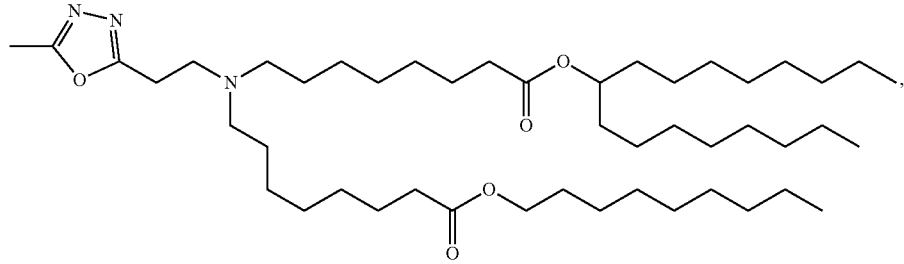
(Compound 231)
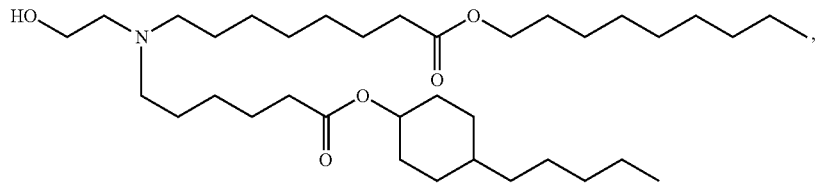
(Compound 232)
and salts and isomers thereof.

In some embodiments, a nanoparticle comprises the following compound:

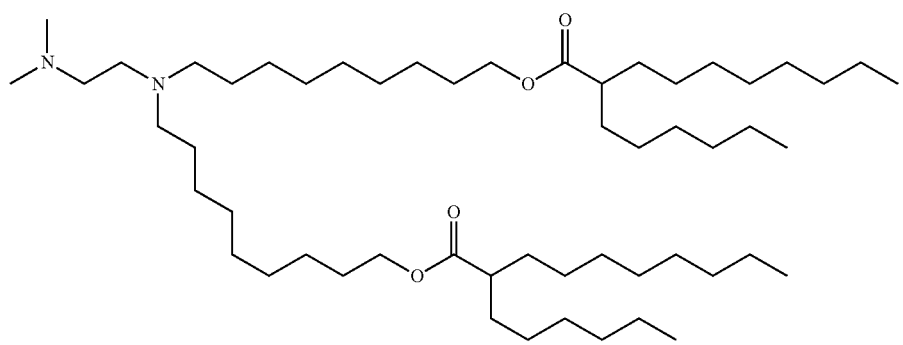

(Compound 233)

or salts and isomers thereof.

In some embodiments, the disclosure features a nanoparticle composition including a lipid component comprising a compound as described herein (e.g., a compound according to Formula (I), (IA), (II), (IIa), (IIb), (IIe), (IId) or (IIe)).

In some embodiments, the disclosure features a pharmaceutical composition comprising a nanoparticle composition according to the preceding embodiments and a pharmaceutically acceptable carrier. For example, the pharmaceutical composition is refrigerated or frozen for storage and/or shipment (e.g., being stored at a temperature of 4° C. or lower, such as a temperature between about −150° C. and about 0° C. or between about −80° C. and about −20° C. (e.g., about −5° C., −10° C., −15° C., −20° C., −25° C., −30° C., −40° C., −50° C., −60° C., −70° C., −80° C., −90° C., −130° C. or −150° C.). For example, the pharmaceutical composition is a solution that is refrigerated for storage and/or shipment at, for example, about −20° C., −30° C., −40° C., −50° C., −60° C., −70° C., or −80° C.

In some embodiments, the disclosure provides a method of delivering a therapeutic and/or prophylactic (e.g., RNA, such as mRNA) to a cell (e.g., a mammalian cell). This method includes the step of administering to a subject (e.g., a mammal, such as a human) a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic, in which administering involves contacting the cell with the nanoparticle composition, whereby the therapeutic and/or prophylactic is delivered to the cell.

In some embodiments, the disclosure provides a method of producing a polypeptide of interest in a cell (e.g., a mammalian cell). The method includes the step of contacting the cell with a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) an mRNA encoding the polypeptide of interest, whereby the mRNA is capable of being translated in the cell to produce the polypeptide.

In some embodiments, the disclosure provides a method of treating a disease or disorder in a mammal (e.g., a human) in need thereof. The method includes the step of administering to the mammal a therapeutically effective amount of a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic (e.g., an mRNA). In some embodiments, the disease or disorder is characterized by dysfunctional or aberrant protein or polypeptide activity. For example, the disease or disorder is selected from the group consisting of rare diseases, infectious diseases, cancer and proliferative diseases, genetic diseases (e.g., cystic fibrosis), autoimmune diseases, diabetes, neurodegenerative diseases, cardio- and reno-vascular diseases, and metabolic diseases.

In some embodiments, the disclosure provides a method of delivering (e.g., specifically delivering) a therapeutic and/or prophylactic to a mammalian organ (e.g., a liver, spleen, lung, or femur). This method includes the step of administering to a subject (e.g., a mammal) a nanoparticle composition including (i) a lipid component including a phospholipid, a PEG lipid, a structural lipid, and a compound of Formula (I), (IA), (II), (IIa), (IIb), (IIc), (IId) or (IIe) and (ii) a therapeutic and/or prophylactic (e.g., an mRNA), in which administering involves contacting the cell with the nanoparticle composition, whereby the therapeutic and/or prophylactic is delivered to the target organ (e.g., a liver, spleen, lung, or femur).

In some embodiments, the disclosure features a method for the enhanced delivery of a therapeutic and/or prophylactic (e.g., an mRNA) to a target tissue (e.g., a liver, spleen, lung, or femur). This method includes administering to a subject (e.g., a mammal) a nanoparticle composition, the composition including (i) a lipid component including a compound of Formula (I), (IA), (II), (IIa), (IIb), (IIc), (IId) or (IIe), a phospholipid, a structural lipid, and a PEG lipid; and (ii) a therapeutic and/or prophylactic, the administering including contacting the target tissue with the nanoparticle composition, whereby the therapeutic and/or prophylactic is delivered to the target tissue.

In some embodiments, the disclosure features a method of lowering immunogenicity comprising introducing the nanoparticle composition of the disclosure into cells, wherein the nanoparticle composition reduces the induction of the cellular immune response of the cells to the nanoparticle composition, as compared to the induction of the cellular immune response in cells induced by a reference composition which comprises a reference lipid instead of a compound of Formula (I), (IA), (II), (IIa), (IIb), (IIc), (IId) or (IIe). For example, the cellular immune response is an innate immune response, an adaptive immune response, or both.

The disclosure also includes methods of synthesizing a compound of Formula (I), (IA), (II), (IIa), (IIb), (IIc), (IId) or (IIe) and methods of making a nanoparticle composition including a lipid component comprising the compound of Formula (I), (IA), (II), (IIa), (IIb), (IIc), (IId) or (IIe).

Modes of Vaccine Administration

Influenza RNA (e.g. mRNA) vaccines may be administered by any route which results in a therapeutically effective outcome. These include, but are not limited, to intradermal, intramuscular, intranasal and/or subcutaneous administration. The present disclosure provides methods comprising administering RNA (e.g., mRNA) vaccines to a subject in need thereof. The exact amount required will vary from subject to subject, depending on the species, age, and general condition of the subject, the severity of the disease, the particular composition, its mode of administration, its mode of activity, and the like. Influenza RNA (e.g., mRNA) vaccines compositions are typically formulated in dosage unit form for ease of administration and uniformity of dosage. It will be understood, however, that the total daily usage of RNA (e.g., mRNA) vaccine compositions may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In some embodiments, influenza disease RNA (e.g. mRNA) vaccines compositions may be administered at dosage levels sufficient to deliver 0.0001 mg/kg to 100 mg/kg, 0.001 mg/kg to 0.05 mg/kg, 0.005 mg/kg to 0.05 mg/kg, 0.001 mg/kg to 0.005 mg/kg, 0.05 mg/kg to 0.5 mg/kg, 0.01 mg/kg to 50 mg/kg, 0.1 mg/kg to 40 mg/kg, 0.5 mg/kg to 30 mg/kg, 0.01 mg/kg to 10 mg/kg, 0.1 mg/kg to 10 mg/kg, or 1 mg/kg to 25 mg/kg, of subject body weight per day, one or more times a day, per week, per month, etc. to obtain the desired therapeutic, diagnostic, prophylactic, or imaging effect (see, e.g., the range of unit doses described in International Publication No WO2013/078199, the contents of which are herein incorporated by reference in their entirety). The desired dosage may be delivered three times a day, two times a day, once a day, every other day, every third day, every week, every two weeks, every three weeks, every four weeks, every 2 months, every three months, every 6 months, etc. In some embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. In exemplary embodiments, influenza RNA (e.g., mRNA) vaccines compositions may be administered at dosage levels sufficient to deliver 0.0005 mg/kg to 0.01 mg/kg, e.g., about 0.0005 mg/kg to about 0.0075 mg/kg, e.g., about 0.0005 mg/kg, about 0.001 mg/kg, about 0.002 mg/kg, about 0.003 mg/kg, about 0.004 mg/kg or about 0.005 mg/kg.

In some embodiments, influenza disease RNA (e.g., mRNA) vaccine compositions may be administered once or twice (or more) at dosage levels sufficient to deliver 0.025 mg/kg to 0.250 mg/kg, 0.025 mg/kg to 0.500 mg/kg, 0.025 mg/kg to 0.750 mg/kg, or 0.025 mg/kg to 1.0 mg/kg.

In some embodiments, influenza disease RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.0100 mg, 0.025 mg, 0.050 mg, 0.075 mg, 0.100 mg, 0.125 mg, 0.150 mg, 0.175 mg, 0.200 mg, 0.225 mg, 0.250 mg, 0.275 mg, 0.300 mg, 0.325 mg, 0.350 mg, 0.375 mg, 0.400 mg, 0.425 mg, 0.450 mg, 0.475 mg, 0.500 mg, 0.525 mg, 0.550 mg, 0.575 mg, 0.600 mg, 0.625 mg, 0.650 mg, 0.675 mg, 0.700 mg, 0.725 mg, 0.750 mg, 0.775 mg, 0.800 mg, 0.825 mg, 0.850 mg, 0.875 mg, 0.900 mg, 0.925 mg, 0.950 mg, 0.975 mg, or 1.0 mg. Higher and lower dosages and frequency of administration are encompassed by the present disclosure. For example, an influenza RNA (e.g., mRNA) vaccine composition may be administered three or four times.

In some embodiments, influenza RNA (e.g., mRNA) vaccine compositions may be administered twice (e.g., Day 0 and Day 7, Day 0 and Day 14, Day 0 and Day 21, Day 0 and Day 28, Day 0 and Day 60, Day 0 and Day 90, Day 0 and Day 120, Day 0 and Day 150, Day 0 and Day 180, Day 0 and 3 months later, Day 0 and 6 months later, Day 0 and 9 months later, Day 0 and 12 months later, Day 0 and 18 months later, Day 0 and 2 years later, Day 0 and 5 years later, or Day 0 and 10 years later) at a total dose of or at dosage levels sufficient to deliver a total dose of 0.010 mg, 0.025 mg, 0.100 mg or 0.400 mg.

In some embodiments, the influenza RNA (e.g., mRNA) vaccine for use in a method of vaccinating a subject is administered to the subject as a single dosage of between 10 μg/kg and 400 μg/kg of the nucleic acid vaccine (in an effective amount to vaccinate the subject). In some embodiments the RNA (e.g., mRNA) vaccine for use in a method of vaccinating a subject is administered to the subject as a single dosage of between 10 μg and 400 μg of the nucleic acid vaccine (in an effective amount to vaccinate the subject). In some embodiments, an influenza RNA (e.g., mRNA) vaccine for use in a method of vaccinating a subject is administered to the subject as a single dosage of 25-1000 μg. In some embodiments, an influenza RNA (e.g., mRNA) vaccine is administered to the subject as a single dosage of 25, 50, 100, 150, 200, 250, 300, 350, 400, 450, 500, 550, 600, 650, 700, 750, 800, 850, 900, 950 or 1000 μg. For example, an influenza RNA (e.g., mRNA) vaccine may be administered to a subject as a single dose of 25-100, 25-500, 50-100, 50-500, 50-1000, 100-500, 100-1000, 250-500, 250-1000, or 500-1000 μg. In some embodiments, an influenza RNA (e.g., mRNA) vaccine for use in a method of vaccinating a subject is administered to the subject as two dosages, the combination of which equals 25-1000 μg of the influenza RNA (e.g., mRNA) vaccine.

An influenza RNA (e.g. mRNA) vaccine pharmaceutical composition described herein can be formulated into a dosage form described herein, such as an intranasal, intratracheal, or injectable (e.g., intravenous, intraocular, intravitreal, intramuscular, intradermal, intracardiac, intraperitoneal, intranasal and subcutaneous).

Influenza Virus RNA (e.g., mRNA) Vaccine Formulations and Methods of Use

Some aspects of the present disclosure provide formulations of the influenza RNA (e.g., mRNA) vaccine, wherein the RNA (e.g., mRNA) vaccine is formulated in an effective amount to produce an antigen specific immune response in a subject (e.g., production of antibodies specific to an influenza antigenic polypeptide). "An effective amount" is a dose of an RNA (e.g., mRNA) vaccine effective to produce an antigen-specific immune response. Also provided herein are methods of inducing an antigen-specific immune response in a subject.

In some embodiments, the antigen-specific immune response is characterized by measuring an anti-influenza antigenic polypeptide antibody titer produced in a subject administered an influenza RNA (e.g., mRNA) vaccine as provided herein. An antibody titer is a measurement of the amount of antibodies within a subject, for example, antibodies that are specific to a particular antigen (e.g., an influenza antigenic polypeptide) or epitope of an antigen. Antibody titer is typically expressed as the inverse of the greatest dilution that provides a positive result. Enzyme-linked immunosorbent assay (ELISA) is a common assay for determining antibody titers, for example.

In some embodiments, an antibody titer is used to assess whether a subject has had an infection or to determine whether immunizations are required. In some embodiments, an antibody titer is used to determine the strength of an autoimmune response, to determine whether a booster immunization is needed, to determine whether a previous vaccine was effective, and to identify any recent or prior infections. In accordance with the present disclosure, an antibody titer may be used to determine the strength of an immune response induced in a subject by the influenza RNA (e.g., mRNA) vaccine.

In some embodiments, an anti-influenza antigenic polypeptide antibody titer produced in a subject is increased by at least 1 log relative to a control. For example, anti-antigenic polypeptide antibody titer produced in a subject may be increased by at least 1.5, at least 2, at least 2.5, or at least 3 log relative to a control. In some embodiments, the anti-antigenic polypeptide antibody titer produced in the subject is increased by 1, 1.5, 2, 2.5 or 3 log relative to a control. In some embodiments, the anti-antigenic polypeptide antibody titer produced in the subject is increased by 1-3 log relative to a control. For example, the anti-antigenic polypeptide antibody titer produced in a subject may be increased by 1-1.5, 1-2, 1-2.5, 1-3, 1.5-2, 1.5-2.5, 1.5-3, 2-2.5, 2-3, or 2.5-3 log relative to a control.

In some embodiments, the anti-influenza antigenic polypeptide antibody titer produced in a subject is increased at least 2 times relative to a control. For example, the anti-antigenic polypeptide antibody titer produced in a subject may be increased at least 3 times, at least 4 times, at least 5 times, at least 6 times, at least 7 times, at least 8 times, at least 9 times, or at least 10 times relative to a control. In some embodiments, the anti-antigenic polypeptide antibody titer produced in the subject is increased 2, 3, 4, 5, 6, 7, 8, 9, or 10 times relative to a control. In some embodiments, the anti-antigenic polypeptide antibody titer produced in a subject is increased 2-10 times relative to a control. For example, the anti-antigenic polypeptide antibody titer produced in a subject may be increased 2-10, 2-9, 2-8, 2-7, 2-6, 2-5, 2-4, 2-3, 3-10, 3-9, 3-8, 3-7, 3-6, 3-5, 3-4, 4-10, 4-9, 4-8, 4-7, 4-6, 4-5, 5-10, 5-9, 5-8, 5-7, 5-6, 6-10, 6-9, 6-8, 6-7, 7-10, 7-9, 7-8, 8-10, 8-9, or 9-10 times relative to a control.

A control, in some embodiments, is the anti-influenza antigenic polypeptide antibody titer produced in a subject who has not been administered an influenza RNA (e.g., mRNA) vaccine of the present disclosure. In some embodiments, a control is an anti-influenza antigenic polypeptide antibody titer produced in a subject who has been administered a live attenuated influenza vaccine. An attenuated vaccine is a vaccine produced by reducing the virulence of a viable (live). An attenuated virus is altered in a manner that renders it harmless or less virulent relative to live, unmodified virus. In some embodiments, a control is an anti-influenza antigenic polypeptide antibody titer produced in a subject administered inactivated influenza vaccine. In some embodiments, a control is an anti-influenza antigenic polypeptide antibody titer produced in a subject administered a recombinant or purified influenza protein vaccine. Recombinant protein vaccines typically include protein antigens that either have been produced in a heterologous expression system (e.g., bacteria or yeast) or purified from large amounts of the pathogenic organism. In some embodiments, a control is an anti-influenza antigenic polypeptide antibody titer produced in a subject who has been administered an influenza virus-like particle (VLP) vaccine.

In some embodiments, an effective amount of an influenza RNA (e.g., mRNA) vaccine is a dose that is reduced compared to the standard of care dose of a recombinant influenza protein vaccine. A "standard of care," as provided herein, refers to a medical or psychological treatment guideline and can be general or specific. "Standard of care" specifies appropriate treatment based on scientific evidence and collaboration between medical professionals involved in the treatment of a given condition. It is the diagnostic and treatment process that a physician/clinician should follow for a certain type of patient, illness or clinical circumstance. A "standard of care dose," as provided herein, refers to the dose of a recombinant or purified influenza protein vaccine, or a live attenuated or inactivated influenza vaccine, that a physician/clinician or other medical professional would administer to a subject to treat or prevent influenza, or a related condition, while following the standard of care guideline for treating or preventing influenza, or a related condition.

In some embodiments, the anti-influenza antigenic polypeptide antibody titer produced in a subject administered an effective amount of an influenza RNA (e.g., mRNA) vaccine is equivalent to an anti-influenza antigenic polypeptide antibody titer produced in a control subject administered a standard of care dose of a recombinant or purified influenza protein vaccine or a live attenuated or inactivated influenza vaccine.

In some embodiments, an effective amount of an influenza RNA (e.g., mRNA) vaccine is a dose equivalent to an at least 2-fold reduction in a standard of care dose of a recombinant or purified influenza protein vaccine. For example, an effective amount of an influenza RNA (e.g., mRNA) vaccine may be a dose equivalent to an at least 3-fold, at least 4-fold, at least 5-fold, at least 6-fold, at least 7-fold, at least 8-fold, at least 9-fold, or at least 10-fold reduction in a standard of care dose of a recombinant or purified influenza protein vaccine. In some embodiments, an effective amount of an influenza RNA (e.g., mRNA) vaccine is a dose equivalent to an at least at least 100-fold, at least 500-fold, or at least 1000-fold reduction in a standard of care dose of a recombinant or purified influenza protein vaccine. In some embodiments, an effective amount of an influenza RNA (e.g., mRNA) vaccine is a dose equivalent to a 2-, 3-, 4-, 5-, 6-, 7-, 8-, 9-, 10-, 20-, 50-, 100-, 250-, 500-, or 1000-fold reduction in a standard of care dose of a recombinant or purified influenza protein vaccine. In some embodiments, the anti-influenza antigenic polypeptide antibody titer produced in a subject administered an effective amount of an influenza RNA (e.g., mRNA) vaccine is equivalent to an anti-influenza antigenic polypeptide antibody titer produced in a control subject administered the standard of care dose of a recombinant or protein influenza protein vaccine or a live attenuated or inactivated influenza vaccine. In some embodiments, an effective amount of an influenza RNA (e.g., mRNA) vaccine is a dose equivalent to a 2-fold to 1000-fold (e.g., 2-fold to 100-fold, 10-fold to 1000-fold) reduction in the standard of care dose of a recombinant or purified influenza protein vaccine, wherein the anti-influenza antigenic polypeptide antibody titer produced in the subject is equivalent to an anti-influenza antigenic polypeptide antibody titer produced in a control subject administered the standard of care dose of a recombinant or purified influenza protein vaccine or a live attenuated or inactivated influenza vaccine.

In some embodiments, the effective amount of an influenza RNA (e.g., mRNA) vaccine is a dose equivalent to a 2 to 1000-, 2 to 900-, 2 to 800-, 2 to 700-, 2 to 600-, 2 to 500-, 2 to 400-, 2 to 300-, 2 to 200-, 2 to 100-, 2 to 90-, 2 to 80-, 2 to 70-, 2 to 60-, 2 to 50-, 2 to 40-, 2 to 30-, 2 to 20-, 2 to 10-, 2 to 9-, 2 to 8-, 2 to 7-, 2 to 6-, 2 to 5-, 2 to 4-, 2 to 3-, 3 to 1000-, 3 to 900-, 3 to 800-, 3 to 700-, 3 to 600-, 3 to 500-, 3 to 400-, 3 to 3 to 00-, 3 to 200-, 3 to 100-, 3 to 90-, 3 to 80-, 3 to 70-, 3 to 60-, 3 to 50-, 3 to 40-, 3 to 30-, 3 to 20-, 3 to 10-, 3 to 9-, 3 to 8-, 3 to 7-, 3 to 6-, 3 to 5-, 3 to 4-, 4 to 1000-, 4 to 900-, 4 to 800-, 4 to 700-, 4 to 600- , 4 to 500-, 4 to 400-, 4 to 300-, 4 to 200-, 4 to 100-, 4 to 90-, 4 to 80-, 4 to 70-, 4 to 60-, 4 to 50-, 4 to 40-, 4 to 30-, 4 to 20-, 4 to 10-, 4 to 9-, 4 to 8-, 4 to 7-, 4 to 6-, 4 to 5-, 4 to 4-, 5 to 1000-, 5 to 900-, 5 to 800-, 5 to 700-, 5 to 600-, 5 to 500-, 5 to 400-, 5 to 300-, 5 to 200-, 5 to 100-, 5 to 90-, 5 to 80-, 5 to 70-, 5 to 60-, 5 to 50-, 5 to 40-, 5 to 30-, 5 to 20-, 5 to 10-, 5 to 9- , 5 to 8-, 5 to 7-, 5 to 6-, 6 to 1000-, 6 to 900-, 6 to 800-, 6 to 700-, 6 to 600-, 6 to 500-, 6 to 400-, 6 to 300-, 6 to 200-, 6 to 100-, 6 to 90-, 6 to 80-, 6 to 70-, 6 to 60-, 6 to 50-, 6 to 40-, 6 to 30-, 6 to 20-, 6 to 10-, 6 to 9-, 6 to 8-, 6 to 7-, 7 to 1000-, 7 to 900-, 7 to 800-, 7 to 700-, 7 to 600-, 7 to 500-, 7 to 400-, 7 to 300-, 7 to 200-, 7 to 100-, 7 to 90-, 7 to 80-, 7 to 70-, 7 to 60-, 7 to 50-, 7 to 40-, 7 to 30-, 7 to 20-, 7 to 10-, 7 to 9-, 7 to 8-, 8 to 1000-, 8 to 900-, 8 to 800-, 8 to 700-, 8 to 600-, 8 to 500-, 8 to 400-, 8 to 300-, 8 to 200-, 8 to 100-, 8 to 90-, 8 to 80-, 8 to 70-, 8 to 60-, 8 to 50-, 8 to 40-, 8 to 30-, 8 to 20-, 8 to 10-, 8 to 9-, 9 to 1000-, 9 to 900-, 9 to 800-, 9 to 700-, 9 to 600-, 9 to 500-, 9 to 400-, 9 to 300-, 9 to 200-, 9 to 100-, 9 to 90-, 9 to 80-, 9 to 70-, 9 to 60-, 9 to 50-, 9 to 40-, 9 to 30-, 9 to 20-, 9 to 10-, 10 to 1000-, 10 to 900-, 10 to 800-, 10 to 700-, 10 to 600-, 10 to 500-, 10 to 400-, 10 to 300-, 10 to 200-, 10 to 100-, 10 to 90-, 10 to 80-, 10 to 70-, 10 to 60-, 10 to 50-, 10 to 40-, 10 to 30-, 10 to 20-, 20 to 1000-, 20 to 900-, 20 to 800-, 20 to 700-, 20 to 600-, 20 to 500-, 20 to 400-, 20 to 300-, 20 to 200-, 20 to 100-, 20 to 90-, 20 to 80-, 20 to 70-, 20 to 60-, 20 to 50-, 20 to 40-, 20 to 30-, 30 to 1000-, 30 to 900-, 30 to 800-, 30 to 700-, 30 to 600-, 30 to 500-, 30 to 400-, 30 to 300-, 30 to 200-, 30 to 100-, 30 to 90-, 30 to 80-, 30 to 70-, 30 to 60-, 30 to 50-, 30 to 40-, 40 to 1000-, 40 to 900-, 40 to 800-, 40 to 700-, 40 to 600-, 40 to 500-, 40 to 400-, 40 to 300-, 40 to 200-, 40 to 100-, 40 to 90-, 40 to 80-, 40 to 70-, 40 to 60-, 40 to 50-, 50 to 1000-, 50 to 900-, 50 to 800-, 50 to 700-, 50 to 600-, 50 to 500-, 50 to 400-, 50 to 300-, 50 to 200-, 50 to 100-, 50 to 90-, 50 to 80-, 50 to 70-, 50 to 60-, 60 to 1000-, 60 to 900-, 60 to 800-, 60 to 700-, 60 to 600-, 60 to 500-, 60 to 400-, 60 to 300-, 60 to 200-, 60 to 100-, 60 to 90-, 60 to 80-, 60 to 70-, 70 to 1000-, 70 to 900-, 70 to 800-, 70 to 700-, 70 to 600-, 70 to 500-, 70 to 400-, 70 to 300-, 70 to 200-, 70 to 100-, 70 to 90-, 70 to 80-, 80 to 1000-, 80 to 900-, 80 to 800-, 80 to 700-, 80 to 600-, 80 to 500-, 80 to 400-, 80 to 300-, 80 to 200-, 80 to 100-, 80 to 90-, 90 to 1000-, 90 to 900-, 90 to 800-, 90 to 700-, 90 to 600-, 90 to 500-, 90 to 400-, 90 to 300-, 90 to 200-, 90 to 100-, 100 to 1000-, 100 to 900-, 100 to 800-, 100 to 700-, 100 to 600-, 100 to 500-, 100 to 400-, 100 to 300-, 100 to 200-, 200 to 1000-, 200 to 900-, 200 to 800-, 200 to 700-, 200 to 600-, 200 to 500-, 200 to 400-, 200 to 300-, 300 to 1000-, 300 to 900-, 300 to 800-, 300 to 700-, 300 to 600-, 300 to 500-, 300 to 400-, 400 to 1000-, 400 to 900-, 400 to 800-, 400 to 700-, 400 to 600-, 400 to 500-, 500 to 1000-, 500 to 900-, 500 to 800-, 500 to 700-, 500 to 600-, 600 to 1000-, 600 to 900-, 600 to 800-, 600 to 700-, 700 to 1000-, 700 to 900-, 700 to 800-, 800 to 1000-, 800 to 900-, or 900 to 1000-fold reduction in the standard of care dose of a recombinant influenza protein vaccine. In some embodiments, the anti-antigenic polypeptide antibody titer produced in the subject is equivalent to an anti-antigenic polypeptide antibody titer produced in a control subject administered the standard of care dose of a recombinant or purified influenza protein vaccine or a live attenuated or inactivated influenza vaccine. In some embodiments, the effective amount is a dose equivalent to (or equivalent to an at least) 2-, 3-, 4-, 5-, 6-, 7-, 8-, 9-, 10-, 20-, 30-, 40-, 50-, 60-, 70-, 80-, 90-, 100-, 110-, 120-, 130-, 140-, 150-, 160-, 170-, 1280-, 190-, 200-, 210-, 220-, 230-, 240-, 250-, 260-, 270-, 280-, 290-, 300-, 310-, 320-, 330-, 340-, 350-, 360-, 370-, 380-, 390-, 400-, 410-, 420-, 430-, 440-, 450-, 4360-, 470-, 480-, 490-, 500-, 510-, 520-, 530-, 540-, 550-, 560-, 5760-, 580-, 590-, 600-, 610-, 620-, 630-, 640-, 650-, 660-, 670-, 680-, 690-, 700-, 710-, 720-, 730-, 740-, 750-, 760-, 770-, 780-, 790-, 800-, 810-, 820-, 830-, 840-, 850-, 860-, 870-, 880-, 890-, 900-, 910-, 920-, 930-, 940-, 950-, 960-, 970-, 980-, 990-, or 1000-fold reduction in the standard of care dose of a recombinant influenza protein vaccine. In some embodiments, an anti-antigenic polypeptide antibody titer produced in the subject is equivalent to an anti-antigenic polypeptide antibody titer produced in a control subject administered the standard of care dose of a recombinant or purified influenza protein vaccine or a live attenuated or inactivated an influenza vaccine.

In some embodiments, the effective amount of an influenza RNA (e.g., mRNA) vaccine is a total dose of 50-1000 kg. In some embodiments, the effective amount of an influenza RNA (e.g., mRNA) vaccine is a total dose of 50-1000, 50-900, 50-800, 50-700, 50-600, 50-500, 50-400, 50-300, 50-200, 50-100, 50-90, 50-80, 50-70, 50-60, 60-1000, 60-900, 60-800, 60-700, 60-600, 60-500, 60-400, 60-300, 60-200, 60-100, 60-90, 60-80, 60-70, 70-1000, 70-900, 70-800, 70-700, 70-600, 70-500, 70-400, 70-300, 70-200, 70-100, 70-90, 70-80, 80-1000, 80-900, 80-800, 80-700, 80-600, 80-500, 80-400, 80-300, 80-200, 80-100, 80-90, 90-1000, 90-900, 90-800, 90-700, 90-600, 90-500, 90-400, 90-300, 90-200, 90-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-900, 600-700, 700-1000, 700-900, 700-800, 800-1000, 800-900, or 900-1000 μg. In some embodiments, the effective amount of an influenza RNA (e.g., mRNA) vaccine is a total dose of 50, 100, 150, 200, 250, 300, 350, 400, 450, 500, 550, 600, 650, 700, 750, 800, 850, 900, 950 or 1000 μg. In some embodiments, the effective amount is a dose of 25-500 μg administered to the subject a total of two times. In some embodiments, the effective amount of an influenza RNA (e.g., mRNA) vaccine is a dose of 25-500, 25-400, 25-300, 25-200, 25-100, 25-50, 50-500, 50-400, 50-300, 50-200, 50-100, 100-500, 100-400, 100-300, 100-200, 150-500, 150-400, 150-300, 150-200, 200-500, 200-400, 200-300, 250-500, 250-400, 250-300, 300-500, 300-400, 350-500, 350-400, 400-500 or 450-500 μg administered to the subject a total of two times. In some embodiments, the effective amount of an influenza RNA (e.g., mRNA) vaccine is a total dose of 25, 50, 100, 150, 200, 250, 300, 350, 400, 450, or 500 µg administered to the subject a total of two times.

Additional Embodiments

1. An influenza virus vaccine or composition or immunogenic composition, comprising:
at least one messenger ribonucleic acid (mRNA) polynucleotide having a 5' terminal cap, an open reading frame encoding at least one influenza antigenic polypeptide, and a 3' polyA tail.
2. The vaccine of paragraph 1, wherein the at least one mRNA polynucleotide is encoded by a sequence identified by SEQ ID NO: 447-457, 459, 461, 505-523, or 570-573.
3. The vaccine of paragraph 1, wherein the at least one mRNA polynucleotide comprises a sequence identified by SEQ ID NO: 491-503, 524-542, or 566-569.
4. The vaccine of paragraph 1, wherein the at least one antigenic polypeptide comprises a sequence identified by SEQ ID NO: 1-444, 458, 460, 462-479, or 543-565.
5. The vaccine of paragraph 1, wherein the at least one mRNA polynucleotide is encoded by a sequence identified by SEQ ID NO: 457.
6. The vaccine of paragraph 1, wherein the at least one mRNA polynucleotide comprises a sequence identified by SEQ ID NO: 501.
7. The vaccine of paragraph 1, wherein the at least one antigenic polypeptide comprises a sequence identified by SEQ ID NO: 458.
8. The vaccine of paragraph 1, wherein the at least one mRNA polynucleotide is encoded by a sequence identified by SEQ ID NO: 459.
9. The vaccine of paragraph 1, wherein the at least one mRNA polynucleotide comprises a sequence identified by SEQ ID NO: 502.
10. The vaccine of paragraph 1, wherein the at least one antigenic polypeptide comprises a sequence identified by SEQ ID NO: 460.
11. The vaccine of paragraph 1, wherein the at least one mRNA polynucleotide is encoded by a sequence identified by SEQ ID NO: 461.
12. The vaccine of paragraph 1, wherein the at least one mRNA polynucleotide comprises a sequence identified by SEQ ID NO: 503.
13. The vaccine of paragraph 1, wherein the at least one antigenic polypeptide comprises a sequence identified by SEQ ID NO: 462.
14. The vaccine of any one of paragraphs 1-13, wherein the 5' terminal cap is or comprises 7mG(5')ppp(5')N1mpNp.
15. The vaccine of any one of paragraphs 1-14, wherein 100% of the uracil in the open reading frame is modified to include N1-methyl pseudouridine at the 5-position of the uracil.
16. The vaccine of any one of paragraphs 1-15, wherein the vaccine is formulated in a lipid nanoparticle comprising: DLin-MC3-DMA; cholesterol; 1,2-Distearoyl-sn-glycero-3-phosphocholine (DSPC); and polyethylene glycol (PEG) 2000-DMG.
17. The vaccine of paragraph 16, wherein the lipid nanoparticle further comprises trisodium citrate buffer, sucrose and water.
18. A influenza virus vaccine or composition or immunogenic composition, comprising:
at least one messenger ribonucleic acid (mRNA) polynucleotide having a 5' terminal cap 7mG(5')ppp(5')N1mpNp, a sequence identified by SEQ ID NO: 501 and a 3' polyA tail, wherein the uracil nucleotides of the sequence identified by SEQ ID NO: 501 are modified to include N1-methyl pseudouridine at the 5-position of the uracil nucleotide.
19. A influenza virus vaccine, comprising:
at least one messenger ribonucleic acid (mRNA) polynucleotide having a 5' terminal cap 7mG(5')ppp(5')N1mpNp, a sequence identified by SEQ ID NO: 502 and a 3' polyA tail, wherein the uracil nucleotides of the sequence identified by SEQ ID NO: 502 are modified to include N1-methyl pseudouridine at the 5-position of the uracil nucleotide.
20. A influenza virus vaccine or composition or immunogenic composition, comprising:
at least one messenger ribonucleic acid (mRNA) polynucleotide having a 5' terminal cap 7mG(5')ppp(5')N1mpNp, a sequence identified by SEQ ID NO: 503 and a 3' polyA tail, wherein the uracil nucleotides of the sequence identified by SEQ ID NO: 503 are modified to include N1-methyl pseudouridine at the 5-position of the uracil nucleotide.
21. The vaccine of any one of paragraphs 18-20 formulated in a lipid nanoparticle comprising DLin-MC3-DMA, cholesterol, 1,2-Distearoyl-sn-glycero-3-phosphocholine (DSPC), and polyethylene glycol (PEG)2000-DMG.
22. The vaccine of any one of paragraphs 1-21 formulated in a lipid nanoparticle comprising at least one cationic lipid selected from compounds of Formula (I):

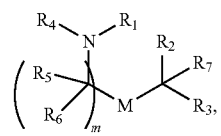

or a salt or isomer thereof, wherein:
R1 is selected from the group consisting of C5-30 alkyl, C5-20 alkenyl, R*YR", YR", and R"M'R';
R2 and R3 are independently selected from the group consisting of H, C1-14 alkyl, C2-14 alkenyl, R*YR", YR", and R*OR", or R2 and R3, together with the atom to which they are attached, form a heterocycle or carbocycle;
R4 is selected from the group consisting of a C3-6 carbocycle, (CH2)nQ, (CH2)nCHQR, CHQR, CQ(R)2, and unsubstituted C1-6 alkyl, where Q is selected from a carbocycle, heterocycle, —OR, —O(CH2)nN(R)2, C(O)OR, —OC(O)R, CX3, CX2H, CXH2, CN, N(R)2, C(O)N(R)2, N(R)C(O)R, N(R)S(O)2R, N(R)C(O)N(R)2, N(R)C(S)N(R)2, N(R)R8, O(CH2)nOR, N(R)C(=NR9)N(R)2, N(R)C(=CHR9)N(R)2, OC(O)N(R)2, N(R)C(O)OR, N(OR)C(O)R, N(OR)S(O)2R, N(OR)C(O)OR, N(OR)C(O)N(R)2, N(OR)C(S)N(R)2, N(OR)C(=NR9)N(R)2, N(OR)C(=CHR9)N(R)2, C(=NR9)N(R)2, C(=NR9)R, C(O)N(R)OR, and —C(R)N(R)2C(O)OR, and each n is independently selected from 1, 2, 3, 4, and 5;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, S, an aryl group, and a heteroaryl group;
R7 is selected from the group consisting of C1-3 alkyl, C2-3 alkenyl, and H;
R8 is selected from the group consisting of C3-6 carbocycle and heterocycle;

R9 is selected from the group consisting of H, CN, NO2, C1-6 alkyl, —OR, —S(O)2R, —S(O)2N(R)2, C2-6 alkenyl, C3-6 carbocycle and heterocycle;
each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C2-12 alkenyl;
each Y is independently a C3-6 carbocycle;
each X is independently selected from the group consisting of F, Cl, Br, and I; and
m is selected from 5, 6, 7, 8, 9, 10, 11, 12, and 13.

23. The vaccine of paragraph 22, wherein a subset of compounds of Formula (I) includes those in which when R4 is (CH2)nQ, (CH2)nCHQR, —CHQR, or CQ(R)2, then (i) Q is not N(R)2 when n is 1, 2, 3, 4 or 5, or (ii) Q is not 5, 6, or 7-membered heterocycloalkyl when n is 1 or 2.

24. The vaccine of paragraph 22, wherein a subset of compounds of Formula (I) includes those in which
R1 is selected from the group consisting of C5-30 alkyl, C5-20 alkenyl, R*YR", YR", and R"M'R';
R2 and R3 are independently selected from the group consisting of H, C1-14 alkyl, C2-14 alkenyl, R*YR", YR", and R*OR", or R2 and R3, together with the atom to which they are attached, form a heterocycle or carbocycle;
R4 is selected from the group consisting of a C3-6 carbocycle, (CH2)nQ, (CH2)nCHQR, CHQR, CQ(R)2, and unsubstituted C1-6 alkyl, where Q is selected from a C3-6 carbocycle, a 5- to 14-membered heteroaryl having one or more heteroatoms selected from N, O, and S, —OR, —O(CH2)nN(R)2, C(O)OR, —OC(O)R, CX3, CX2H, CXH2, CN, C(O)N(R)2, N(R)C(O)R, N(R)S(O)2R, N(R)C(O)N(R)2, N(R)C(S)N(R)2, CRN(R)2C(O)OR, N(R)R8, O(CH2)nOR, N(R)C(=NR9)N(R)2, N(R)C(=CHR9)N(R)2, OC(O)N(R)2, N(R)C(O)OR, N(OR)C(O)R, N(OR)S(O)2R, N(OR)C(O)OR, N(OR)C(O)N(R)2, N(OR)C(S)N(R)2, N(OR)C(=NR9)N(R)2, N(OR)C(=CHR9)N(R)2, C(=NR9)N(R)2, C(=NR9)R, C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and C1-3 alkyl, and each n is independently selected from 1, 2, 3, 4, and 5;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, S, an aryl group, and a heteroaryl group;
R7 is selected from the group consisting of C1-3 alkyl, C2-3 alkenyl, and H;
R8 is selected from the group consisting of C3-6 carbocycle and heterocycle;
R9 is selected from the group consisting of H, CN, NO2, C1-6 alkyl, —OR, —S(O)2R, —S(O)2N(R)2, C2-6 alkenyl, C3-6 carbocycle and heterocycle;
each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C2-12 alkenyl;
each Y is independently a C3-6 carbocycle;
each X is independently selected from the group consisting of F, Cl, Br, and I; and
m is selected from 5, 6, 7, 8, 9, 10, 11, 12, and 13,
or salts or isomers thereof.

25. The vaccine of paragraph 22, wherein a subset of compounds of Formula (I) includes those in which
R1 is selected from the group consisting of C5-30 alkyl, C5-20 alkenyl, R*YR", YR", and R"M'R';
R2 and R3 are independently selected from the group consisting of H, C1-14 alkyl, C2-14 alkenyl, R*YR", YR", and R*OR", or R2 and R3, together with the atom to which they are attached, form a heterocycle or carbocycle;
R4 is selected from the group consisting of a C3-6 carbocycle, (CH2)nQ, (CH2)nCHQR, CHQR, CQ(R)2, and unsubstituted C1-6 alkyl, where Q is selected from a C3-6 carbocycle, a 5- to 14-membered heterocycle having one or more heteroatoms selected from N, O, and S, —OR, —O(CH2)nN(R)2, C(O)OR, —OC(O)R, CX3, CX2H, CXH2, CN, C(O)N(R)2, N(R)C(O)R, N(R)S(O)2R, N(R)C(O)N(R)2, N(R)C(S)N(R)2, CRN(R)2C(O)OR, N(R)R8, O(CH2)nOR, N(R)C(=NR9)N(R)2, N(R)C(=CHR9)N(R)2, OC(O)N(R)2, N(R)C(O)OR, N(OR)C(O)R, N(OR)S(O)2R, N(OR)C(O)OR, N(OR)C(O)N(R)2, N(OR)C(S)N(R)2, N(OR)C(=NR9)N(R)2, N(OR)C(=CHR9)N(R)2, C(=NR9)R, C(O)N(R)OR, and C(=NR9)N(R)2, and each n is independently selected from 1, 2, 3, 4, and 5; and when Q is a 5- to 14-membered heterocycle and (i) R4 is (CH2)nQ in which n is 1 or 2, or (ii) R4 is (CH2)nCHQR in which n is 1, or (iii) R4 is CHQR, and CQ(R)2, then Q is either a 5- to 14-membered heteroaryl or 8- to 14-membered heterocycloalkyl;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, S, an aryl group, and a heteroaryl group;
R7 is selected from the group consisting of C1-3 alkyl, C2-3 alkenyl, and H;
R8 is selected from the group consisting of C3-6 carbocycle and heterocycle;
R9 is selected from the group consisting of H, CN, NO2, C1-6 alkyl, —OR, —S(O)2R, —S(O)2N(R)2, C2-6 alkenyl, C3-6 carbocycle and heterocycle;
each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C2-12 alkenyl;
each Y is independently a C3-6 carbocycle;
each X is independently selected from the group consisting of F, Cl, Br, and I; and
m is selected from 5, 6, 7, 8, 9, 10, 11, 12, and 13,
or salts or isomers thereof.

26. The vaccine of paragraph 22, wherein a subset of compounds of Formula (I) includes those in which
R1 is selected from the group consisting of C5-30 alkyl, C5-20 alkenyl, R*YR", YR", and R"M'R';

R2 and R3 are independently selected from the group consisting of H, C1-14 alkyl, C2-14 alkenyl, R*YR", YR", and R*OR", or R2 and R3, together with the atom to which they are attached, form a heterocycle or carbocycle;
R4 is selected from the group consisting of a C3-6 carbocycle, (CH2)nQ, (CH2)nCHQR, CHQR, CQ(R)2, and unsubstituted C1-6 alkyl, where Q is selected from a C3-6 carbocycle, a 5- to 14-membered heteroaryl having one or more heteroatoms selected from N, O, and S, —OR, —O(CH2)nN(R)2, C(O)OR, —OC(O)R, CX3, CX2H, CXH2, CN, C(O)N(R)2, N(R)C(O)R, N(R)S(O)2R, N(R)C(O)N(R)2, N(R)C(S)N(R)2, CRN(R)2C(O)OR, N(R)R8, O(CH2)nOR, N(R)C(=NR9)N(R)2, N(R)C(=CHR9)N(R)2, OC(O)N(R)2, N(R)C(O)OR, N(OR)C(O)R, N(OR)S(O)2R, N(OR)C(O)OR, N(OR)C(O)N(R)2, N(OR)C(S)N(R)2, N(OR)C(=NR9)N(R)2, N(OR)C(=CHR9)N(R)2, C(=NR9)R, C(O)N(R)OR, and C(=NR9)N(R)2, and each n is independently selected from 1, 2, 3, 4, and 5;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, SS, an aryl group, and a heteroaryl group;
R7 is selected from the group consisting of C1-3 alkyl, C2-3 alkenyl, and H;
R8 is selected from the group consisting of C3-6 carbocycle and heterocycle;
R9 is selected from the group consisting of H, CN, NO2, C1-6 alkyl, —OR, —S(O)2R, —S(O)2N(R)2, C2-6 alkenyl, C3-6 carbocycle and heterocycle;
each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C2-12 alkenyl;
each Y is independently a C3-6 carbocycle;
each X is independently selected from the group consisting of F, Cl, Br, and I; and
m is selected from 5, 6, 7, 8, 9, 10, 11, 12, and 13,
or salts or isomers thereof.
27. The vaccine of paragraph 22, wherein a subset of compounds of Formula (I) includes those in which
R1 is selected from the group consisting of C5-30 alkyl, C5-20 alkenyl, R*YR", YR", and R"M'R';
R2 and R3 are independently selected from the group consisting of H, C2-14 alkyl, C2-14 alkenyl, R*YR", YR", and R*OR", or R2 and R3, together with the atom to which they are attached, form a heterocycle or carbocycle;
R4 is (CH2)nQ or (CH2)nCHQR, where Q is N(R)2, and n is selected from 3, 4, and 5;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, SS, an aryl group, and a heteroaryl group;
R7 is selected from the group consisting of C1-3 alkyl, C2-3 alkenyl, and H; each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C1-12 alkenyl;
each Y is independently a C3-6 carbocycle;
each X is independently selected from the group consisting of F, Cl, Br, and I; and
m is selected from 5, 6, 7, 8, 9, 10, 11, 12, and 13,
or salts or isomers thereof.
28. The vaccine of paragraph 22, wherein a subset of compounds of Formula (I) includes those in which
R1 is selected from the group consisting of C5-30 alkyl, C5-20 alkenyl, R*YR", YR", and R"M'R';
R2 and R3 are independently selected from the group consisting of C1-14 alkyl, C2-14 alkenyl, R*YR", YR", and R*OR", or R2 and R3, together with the atom to which they are attached, form a heterocycle or carbocycle;
R4 is selected from the group consisting of (CH2)nQ, (CH2)nCHQR, CHQR, and CQ(R)2, where Q is N(R)2, and n is selected from 1, 2, 3, 4, and 5;
each R5 is independently selected from the group consisting of C1-3 alkyl, C2-3 alkenyl, and H;
each R6 is independently selected from the group consisting of C1-3 alkyl, C2-3 alkenyl, and H;
M and M' are independently selected from C(O)O, OC(O), C(O)N(R'), N(R')C(O), C(O), C(S), C(S)S, SC(S), CH(OH), P(O)(OR')O, S(O)2, SS, an aryl group, and a heteroaryl group;
R7 is selected from the group consisting of C1-3 alkyl, C2-3 alkenyl, and H;
each R is independently selected from the group consisting of C1-3 alkyl, C2-3 alkenyl, and H;
each R' is independently selected from the group consisting of C1-18 alkyl, C2-18 alkenyl, R*YR", YR", and H;
each R" is independently selected from the group consisting of C3-14 alkyl and C3-14 alkenyl;
each R* is independently selected from the group consisting of C1-12 alkyl and C1-12 alkenyl;
each Y is independently a C3-6 carbocycle;
each X is independently selected from the group consisting of F, Cl, Br, and I; and
m is selected from 5, 6, 7, 8, 9, 10, 11, 12, and 13,
or salts or isomers thereof.
29. The vaccine of paragraph 22, wherein a subset of compounds of Formula (I) includes those of Formula (IA):

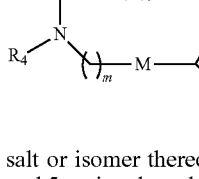

or a salt or isomer thereof, wherein l is selected from 1, 2, 3, 4, and 5; m is selected from 5, 6, 7, 8, and 9; M1 is a bond or M'; R4 is unsubstituted C1-3 alkyl, or (CH2)nQ, in which Q is OH, NHC(S)N(R)2, NHC(O)N(R)2, N(R)C(O)R, N(R)S(O)2R, N(R)R8, NHC(=NR9)N(R)2, NHC(=CHR9)N(R)2, —OC(O)N(R)2, N(R)C(O)OR, heteroaryl or heterocycloalkyl; M and M' are independently selected from C(O)O, OC(O), C(O)N(R'), P(O)(OR')O, SS, an aryl group, and a heteroaryl group; and R2 and R3 are independently selected from the group consisting of H, C1-14 alkyl, and C2-14 alkenyl.

This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

EXAMPLES

Example 1: Manufacture of Polynucleotides

According to the present disclosure, the manufacture of polynucleotides and/or parts or regions thereof may be accomplished utilizing the methods taught in International Publication WO2014/152027, entitled "Manufacturing Methods for Production of RNA Transcripts," the contents of which is incorporated herein by reference in its entirety.

Purification methods may include those taught in International Publication WO2014/152030 and International Publication WO2014/152031, each of which is incorporated herein by reference in its entirety.

Detection and characterization methods of the polynucleotides may be performed as taught in International Publication WO2014/144039, which is incorporated herein by reference in its entirety.

Characterization of the polynucleotides of the disclosure may be accomplished using polynucleotide mapping, reverse transcriptase sequencing, charge distribution analysis, detection of RNA impurities, or any combination of two or more of the foregoing. "Characterizing" comprises determining the RNA transcript sequence, determining the purity of the RNA transcript, or determining the charge heterogeneity of the RNA transcript, for example. Such methods are taught in, for example, International Publication WO2014/144711 and International Publication WO2014/144767, the content of each of which is incorporated herein by reference in its entirety.

Example 2: Chimeric Polynucleotide Synthesis

According to the present disclosure, two regions or parts of a chimeric polynucleotide may be joined or ligated using triphosphate chemistry. A first region or part of 100 nucleotides or less is chemically synthesized with a 5' monophosphate and terminal 3'desOH or blocked OH, for example. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

For ligation methods, ligation with DNA T4 ligase, followed by treatment with DNase should readily avoid concatenation.

The entire chimeric polynucleotide need not be manufactured with a phosphate-sugar backbone. If one of the regions or parts encodes a polypeptide, then such region or part may comprise a phosphate-sugar backbone.

Ligation is then performed using any known click chemistry, orthoclick chemistry, solulink, or other bioconjugate chemistries known to those in the art.

Synthetic Route

The chimeric polynucleotide may be made using a series of starting segments. Such segments include:

(a) a capped and protected 5' segment comprising a normal 3'OH (SEG. 1)

(b) a 5' triphosphate segment, which may include the coding region of a polypeptide and a normal 3'OH (SEG. 2)

(c) a 5' monophosphate segment for the 3' end of the chimeric polynucleotide (e.g., the tail) comprising cordycepin or no 3'OH (SEG. 3)

After synthesis (chemical or IVT), segment 3 (SEG. 3) may be treated with cordycepin and then with pyrophosphatase to create the 5' monophosphate.

Segment 2 (SEG. 2) may then be ligated to SEG. 3 using RNA ligase. The ligated polynucleotide is then purified and treated with pyrophosphatase to cleave the diphosphate. The treated SEG. 2-SEG. 3 construct may then be purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3: PCR for cDNA Production

PCR procedures for the preparation of cDNA may be performed using 2×KAPA HIFI™ HotStart ReadyMix by Kapa Biosystems (Woburn, Mass.). This system includes 2×KAPA ReadyMix 12.5 µl; Forward Primer (10 µM) 0.75 µl; Reverse Primer (10 µM) 0.75 µl; Template cDNA 100 ng; and dH$_2$O diluted to 25.0 µl. The reaction conditions may be at 95° C. for 5 min. The reaction may be performed for 25 cycles of 98° C. for 20 sec, then 58° C. for 15 sec, then 72° C. for 45 sec, then 72° C. for 5 min, then 4° C. to termination.

The reaction may be cleaned up using Invitrogen's PURELINK™ PCR Micro Kit (Carlsbad, Calif.) per manufacturer's instructions (up to 5 µg). Larger reactions may require a cleanup using a product with a larger capacity. Following the cleanup, the cDNA may be quantified using the NANODROP™ and analyzed by agarose gel electrophoresis to confirm that the cDNA is the expected size. The cDNA may then be submitted for sequencing analysis before proceeding to the in vitro transcription reaction.

Example 4: In Vitro Transcription (IVT)

The in vitro transcription reaction generates RNA polynucleotides. Such polynucleotides may comprise a region or part of the polynucleotides of the disclosure, including chemically modified RNA (e.g., mRNA) polynucleotides. The chemically modified RNA polynucleotides can be uniformly modified polynucleotides. The in vitro transcription reaction utilizes a custom mix of nucleotide triphosphates (NTPs). The NTPs may comprise chemically modified NTPs, or a mix of natural and chemically modified NTPs, or natural NTPs.

A typical in vitro transcription reaction includes the following:

| | | |
|---|---|---|
| 1) | Template cDNA | 1.0 µg |
| 2) | 10x transcription buffer (400 mM Tris-HCl pH 8.0, 190 mM MgCl$_2$, 50 mM DTT, 10 mM Spermidine) | 2.0 µl |
| 3) | Custom NTPs (25 mM each) | 0.2 µl |
| 4) | RNase Inhibitor | 20 U |
| 5) | T7 RNA polymerase | 3000 U |
| 6) | dH$_2$0 | up to 20.0 µl. and |
| 7) | Incubation at 37° C. for 3 hr-5 hrs. | |

The crude IVT mix may be stored at 4° C. overnight for cleanup the next day. 1 U of RNase-free DNase may then be used to digest the original template. After 15 minutes of incubation at 37° C., the mRNA may be purified using Ambion's MEGACLEAR™ Kit (Austin, Tex.) following the manufacturer's instructions. This kit can purify up to 500 µg of RNA. Following the cleanup, the RNA polynucleotide may be quantified using the NANODROP™ and analyzed by agarose gel electrophoresis to confirm the RNA polynucleotide is the proper size and that no degradation of the RNA has occurred.

Example 5: Enzymatic Capping

Capping of a RNA polynucleotide is performed as follows where the mixture includes: IVT RNA 60 µg-180 µg and dH$_2$O up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400 U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The RNA polynucleotide may then be purified using Ambion's MEGACLEAR™ Kit (Austin, Tex.) following the manufacturer's instructions. Following the cleanup, the RNA may be quantified using the NANODROP™ (ThermoFisher, Waltham, Mass.) and analyzed by agarose gel electrophoresis to confirm the RNA polynucleotide is the proper size and that no degradation of the RNA has occurred. The RNA polynucleotide product may also be sequenced by running a reverse-transcription-PCR to generate the cDNA for sequencing.

Example 6: PolyA Tailing Reaction

Without a poly-T in the cDNA, a poly-A tailing reaction must be performed before cleaning the final product. This is done by mixing capped IVT RNA (100 µl); RNase Inhibitor (20 U); 10× Tailing Buffer (0.5 M Tris-HCl (pH 8.0), 2.5 M NaCl, 100 mM MgCl$_2$) (12.0 µl); 20 mM ATP (6.0 µl); Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGACLEAR™ kit (Austin, Tex.) (up to 500 µg). Poly-A Polymerase may be a recombinant enzyme expressed in yeast.

It should be understood that the processivity or integrity of the polyA tailing reaction may not always result in an exact size polyA tail. Hence, polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the present disclosure.

Example 7: Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5')ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8: Capping Assays

Protein Expression Assay

Polynucleotides (e.g., mRNA) encoding a polypeptide, containing any of the caps taught herein, can be transfected into cells at equal concentrations. The amount of protein secreted into the culture medium can be assayed by ELISA at 6, 12, 24 and/or 36 hours post-transfection. Synthetic polynucleotides that secrete higher levels of protein into the medium correspond to a synthetic polynucleotide with a higher translationally-competent cap structure.

Purity Analysis Synthesis

RNA (e.g., mRNA) polynucleotides encoding a polypeptide, containing any of the caps taught herein can be compared for purity using denaturing Agarose-Urea gel electrophoresis or HPLC analysis. RNA polynucleotides with a single, consolidated band by electrophoresis correspond to the higher purity product compared to polynucleotides with multiple bands or streaking bands. Chemically modified RNA polynucleotides with a single HPLC peak also correspond to a higher purity product. The capping reaction with a higher efficiency provides a more pure polynucleotide population.

Cytokine Analysis

RNA (e.g., mRNA) polynucleotides encoding a polypeptide, containing any of the caps taught herein can be transfected into cells at multiple concentrations. The amount of pro-inflammatory cytokines, such as TNF-alpha and IFN-beta, secreted into the culture medium can be assayed by ELISA at 6, 12, 24 and/or 36 hours post-transfection. RNA polynucleotides resulting in the secretion of higher levels of pro-inflammatory cytokines into the medium correspond to a polynucleotides containing an immune-activating cap structure.

Capping Reaction Efficiency

RNA (e.g., mRNA) polynucleotides encoding a polypeptide, containing any of the caps taught herein can be analyzed for capping reaction efficiency by LC-MS after nuclease treatment. Nuclease treatment of capped polynucleotides yield a mixture of free nucleotides and the capped 5'-5-triphosphate cap structure detectable by LC-MS. The amount of capped product on the LC-MS spectra can be expressed as a percent of total polynucleotide from the reaction and correspond to capping reaction efficiency. The cap structure with a higher capping reaction efficiency has a higher amount of capped product by LC-MS.

Example 9: Agarose Gel Electrophoresis of Modified RNA or RT PCR Products

Individual RNA polynucleotides (200-400 ng in a 20 μl volume) or reverse transcribed PCR products (200-400 ng) may be loaded into a well on a non-denaturing 1.2% Agarose E-Gel (Invitrogen, Carlsbad, Calif.) and run for 12-15 minutes, according to the manufacturer protocol.

Example 10: NANODROP™ Modified RNA Quantification and UV Spectral Data

Chemically modified RNA polynucleotides in TE buffer (1 μl) are used for NANODROP™ UV absorbance readings to quantitate the yield of each polynucleotide from an chemical synthesis or in vitro transcription reaction.

Example 11: Formulation of Modified mRNA Using Lipidoids

RNA (e.g., mRNA) polynucleotides may be formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may be used as a starting point. After formation of the particle, polynucleotide is added and allowed to integrate with the complex. The encapsulation efficiency is determined using a standard dye exclusion assays.

Example 12: Mouse Immunogenicity Studies

Comparison of HA Stem Antigens

In this example, assays were carried out to evaluate the immune response to influenza virus vaccine antigens delivered using an mRNA/LNP platform in comparison to protein antigens. The instant study was designed to test the immunogenicity in mice of candidate influenza virus vaccines comprising an mRNA polynucleotide encoding HA stem protein obtained from different strains of influenza virus. Animals tested were 6-8 week old female BALB/c mice obtained from Charles River Laboratories. Test vaccines included the following mRNAs formulated in MC3 LNP: stem of H1/Puerto Rico/8/1934 (based on Mallajosyula V et al. *PNAS* 2014 Jun. 24; 111(25):E2514-23), stem of H1/New Caledonia/20/1999 (based on Mallajosyula V et al. *PNAS* 2014 Jun. 24; 111(25):E2514-23), stem of H1/California/04/2009 (based on Mallajosyula V et al. *PNAS* 2014 Jun. 24; 111(25):E2514-23), stem of H5/Vietnam/1194/2004 (based on Mallajosyula V et al. *PNAS* 2014 Jun. 24; 111(25):E2514-23), stem of H10/Jiangxi-Donghu/346/2013, and full-length H10/Jiangxi-Donghu/346/2013.

Protein vaccines tested in this study included the pH1HA10-Foldon protein, as described in Mallajosyula et al. *Proc Natl Acad Sci USA*. 2014; 111(25):E2514-23. Additional controls included MC3 (control for effects of LNP) and PR8 influenza virus.

Mice were immunized intramuscularly with a total volume of 100 μL of each test vaccine, which was administered in a 50 μL immunization to each quadricep, except for administration of the PR8 influenza virus control which was delivered intranasally in a volume of 20 μL while the animals were sedated with a mixture of Ketamine and Xylazine. The group numbers for each test vaccine along with the vaccine dose are outlined in the table below:

TABLE 1

RNA Test Vaccines

| Group # | Antigen | dose | formulation |
|---|---|---|---|
| 1 | H10/Jiangxi-Donghu/346/2013 full-length RNA | 10 μg | MC3 |
| 2 | H10N8 A/JX346/2013 stem RNA | 10 μg | MC3 |
| 3 | H1N1 A/Puerto Rico/8/1934 stem RNA | 10 μg | MC3 |
| 4 | H1N1 A/New Caledonia/20/99 stem RNA | 10 μg | MC3 |
| 5 | H1N1 A/California/04/2009 stem RNA | 10 μg | MC3 |
| 6 | H5N1 A/Vietnam/1203/2004 stem RNA | 10 μg | MC3 |
| 7 | pH1HA10-Foldon protein | 20 μg | CpG 7909 |
| 8 | MC3 | 0 μg | MC3 |
| 9 | 0.1 LD90 PR8 virus | 0.1 LD90 | None |

Mice were immunized with two doses of the various influenza virus RNA vaccine formulations at weeks 0 and 3, and serum was collected two weeks after immunization with the second dose.

To test the sera for the presence of antibodies capable of binding to hemagglutinin (HA) from a wide variety of influenza strains, ELISA plates were coated with 100 ng of the following recombinant HAs obtained from Sino Biological Inc.: Influenza A H1N1 (A/New Caledonia/20/99), cat #11683-V08H; Influenza A H3N2 (A/Aichi/2/1968), cat #11707-V08H; Influenza A H1N1 (A/California/04/2009) cat #11055-V08H; Influenza A H1N1 (A/Puerto Rico/8/34) cat #11684-V08H; Influenza A H3N2 (A/Brisbane/10/2007), cat #11056-V08H; Influenza A H2N2 (A/Japan/305/1957) cat #11088-V08H; Influenza A H7N9 (A/Anhui/1/2013) cat #40103-V08H; Influenza H5N1 (A/Vietnam/1194/2004) cat #11062-V08H1; Influenza H9N2 (A/Hong Kong/1073/99) cat #11229-V08H and Influenza A H10N8 (A/Jiangxi-Donghu/346/2013) cat #40359-V08B. After coating, the plates were washed, blocked with Phosphate Buffered Saline with 0.05% Tween-20 (PBST)+3% milk, and 100 μL of control antibodies or sera from immunized mice (diluted in PBST+3% milk) were added to the top well of each plate and serially diluted. Plates were sealed and incubated at room temperature for 2 hours. Plates were washed, and goat anti-mouse IgG (H+L)-HRP conjugate (Novex, diluted 1:2000 in PBST/3% milk) was added to each well containing mouse sera. Plates were incubated at room temperature for 1 hr, washed, and incubated with TMB substrate (Thermo Scientific). The color was allowed to develop for 10 minutes and then quenched with 100 µL of 2N sulfuric acid. The plates were read at 450 nM on a microplate reader. Endpoint titers (2.5-fold above background) were calculated.

In FIG. 1, the vaccines tested are shown on the y-axis and the endpoint titer to HA from each of the different strains of influenza are plotted. HAs from group 1 (H1, H2, H5, H9) strains of influenza are indicated by filled circles while HAs from group 2 (H3, H7, H10) strains of influenza are indicated by open circles. FIG. 1 illustrates that mRNA based vaccines encoding HA-based antigens that are encapsulated in the MC3 lipid nanoparticle induced high antibody binding titers to HA. FIG. 1 also illustrates that mRNA vaccines designed to express a portion of the stem domain from different H1N1 or H5N1 strains of influenza elicited high antibody titers that were capable of binding all strains of group 1 HA tested as well as several group 2 strains. FIG. 1 also illustrates that mRNA vaccines designed to express a portion of the H1N1 A/California/04/2009 stem domain induced higher titers than a protein vaccine of the same stem domain.

In another mouse immunogenicity study, the immune response to additional influenza virus vaccine antigens delivered using an mRNA/LNP platform was evaluated. The purpose of this study was to evaluate the ability of a second set of mRNA vaccine antigens to elicit cross-protective immune responses in the mouse and to assess the potential for mRNA vaccines encoding influenza HA antigens to be co-dosed. Animals tested were 6-8 week old female BALB/c mice obtained from Charles River Laboratories. Test vaccines included the following mRNAs formulated in MC3 LNP: H1HA6 (based on Bommakanti G et al. *J Virol.* 2012 December; 86(24):13434-44); H3HA6 (based on Bommakanti G et al. *PNAS* 2010 Aug. 3; 107(31):13701-6); H1HA10-Foldon_delta Ngly; eH1HA (ectodomain of HA from H1N1 A/Puerto Rico/8/34); eH1HA_native signal seq (eH1HA with its native signal sequence); H3N2 A/Wisconsin/67/2005 stem; H3N2 A/Hong Kong/1/1968 stem (based on Mallajosyula V et al. *Front Immunol.* 2015 Jun. 26; 6:329); H7N9 A/Anhui/1/2013 stem; H1N1 A/California/04/2009 stem RNA (based on Mallajosyula V et al. *PNAS* 2014 Jun. 24; 111(25):E2514-23); and H1N1 A/Puerto Rico/8/1934 stem RNA (based on Mallajosyula V et al. *PNAS* 2014 Jun. 24; 111(25):E2514-23).

Controls included: MC3 (control for effects of LNP); Naïve (unvaccinated animals); and vaccination with H1N1 A/PR/8/34 and H3N2 A/HK/1/68 influenza viruses (positive controls).

Mice were immunized intramuscularly with a total volume of 100 μL of each test vaccine, which was administered in a 50 μL immunization to each quadricep, except for administration of the H1N1 A/PR/8/34 and H3N2 A/HK/1/68 virus influenza virus controls which were delivered intranasally in a volume of 20 μL while the animals were sedated with a mixture of Ketamine and Xylazine. The group numbers for each test vaccine along with the vaccine dose are outlined in the table below:

TABLE 2

Test Vaccines

| Group # | Antigen | Antigen dose | Formulation | Volume, Route |
|---|---|---|---|---|
| 1 | H1HA6 RNA | 10 μg | MC3 | 100 μl, i.m. |
| 2 | H3HA6 RNA | 10 μg | MC3 | 100 μl, i.m. |
| 3 | H1HA10-Foldon_delta Ngly | 10 μg | MC3 | 100 μl, i.m. |
| 4 | eH1HA | 10 μg | MC3 | 100 μl, i.m. |
| 5 | eH1HA_native signal seq | 10 μg | MC3 | 100 μl, i.m. |
| 6 | H3N2 A/Wisconsin/67/2005 stem RNA | 10 μg | MC3 | 100 μl, i.m. |
| 7 | H3N2 A/Hong Kong/1/1968 stem RNA | 10 μg | MC3 | 100 μl, i.m. |
| 8 | H7N9 A/Anhui/1/2013 stem RNA | 10 μg | MC3 | 100 μl, i.m. |
| 9 | H1N1 A/Puerto Rico/8/1934 stem RNA AND H3N2 A/Wisconsin/67/2005 stem RNA (RNAs mixed prior to formulation) | 10 μg | MC3 | 100 μl, i.m. |
| 10 | H1N1 A/Puerto Rico/8/1934 stem RNA AND H3N2 A/Wisconsin/67/2005 stem RNA (RNAs formulated and then mixed | 10 μg | MC3 | 100 μl, i.m. |
| 11 | H1N1 A/California/04/2009 stem RNA | 10 μg | MC3 | 100 μl, i.m. |
| 12 | H1N1 A/Puerto Rico/8/1934 stem RNA | 10 μg | MC3 | 100 μl, i.m. |
| 13 | MC3 | 0 μg | MC3 | 100 μl, i.m. |
| 14 | Naïve | 0 μg | None | None |
| 15 | H3N2 A/HK/1/68 virus | 0.1 LD90 | None | 20 μl, i.n. |
| 16 | H1N1 A/PR/8/34 virus | 0.1 LD90 | None | 20 μl, i.n. |

Animals were immunized on the study start day and then again three weeks after the initial immunization. Sera were collected from the animals two weeks after the second dose. To test the sera for the presence of antibodies capable of binding to hemagglutinin (HA) from a wide variety of influenza strains, ELISA plates were coated with 100 ng of the following recombinant HAs obtained from Sino Biological Inc.: Influenza A H1N1 (A/New Caledonia/20/99), cat #11683-V08H; Influenza A H3N2 (A/Aichi/2/1968), cat #11707-V08H; Influenza A H1N1 (A/California/04/2009) cat #11055-V08H; Influenza A H1N1 (A/Puerto Rico/8/34) cat #11684-V08H; Influenza A H3N2 (A/Brisbane/10/2007), cat #11056-V08H; Influenza A H2N2 (A/Japan/305/1957) cat #11088-V08H; Influenza A H7N9 (A/Anhui/1/2013) cat #40103-V08H and Influenza A H3N2 (A/Moscow/10/99) cat #40154-V08. The ELISA assay was performed and endpoint titers were calculated as described above. FIGS. 2 and 3 show the endpoint anti-HA antibody titers following the second immunization with the test vaccines. The vaccines tested are shown on the x-axis and the binding to HA from each of the different strains of influenza is plotted. All mRNA vaccines encoding HA stem were immunogenic and elicited a robust antibody response recognizing HA from a diverse set of influenza A virus strains. The H1HA6, eH1HA, and eH1HA_native-signal-sequence mRNAs elicited the highest overall binding titers across the panel of group 1 HAs, while the H3HA6 RNA elicited the highest overall binding titers across group 2 Has (FIG. 2). Immunogenicity of combinations of stem mRNA vaccines was also tested. In this study, individual mRNAs were mixed prior to formulation with LNP (Group 9, co-form) or individual mRNAs were formulated with LNP prior to mixing (Group 10, mix-form). As shown in FIG. 3, combining H1 and H3 stem-based mRNAs did not result in interference in the immune response to either antigen, regardless of the method of formulation.

Example 13: Mouse Efficacy Studies Influenza A Challenge #1

This study was designed to test the immunogenicity and efficacy in mice of candidate influenza virus vaccines. Animals tested were 6-8 week old female BALB/c mice obtained from Charles River Laboratories. Test vaccines included the following mRNAs formulated in MC3 LNP: NIHGen6HASS-foldon mRNA (based on Yassine et al. *Nat. Med.* 2015 September; 21(9):1065-70), an mRNA encoding the nucleoprotein NP from an H3N2 strain, or one of several combinations of NIHGen6HASS-foldon and NP mRNAs. Several methods of vaccine antigen co-delivery were tested including: mixing individual mRNAs prior to formulation with LNP (co-form), formulation of individual mRNAs prior to mixing (mix ind LNPs), and formulating mRNAs individually and injecting distal sites (opposite legs) (ind LNPs remote). Control animals were vaccinated with an RNA encoding the ectodomain of the HA from H1N1 A/Puerto Rico/8/1934 (eH1HA, positive control) or empty MC3 LNP (to control for effects of the LNP) or were not vaccinated (naïve).

At week 0 and week 3, animals were immunized intramuscularly (IM) with a total volume of 100 µL of each test vaccine, which was administered in a 50 µL immunization to each quadricep. Candidate influenza virus vaccines evaluated in this study were described above and are outlined in the table below. Sera were collected from all animals two weeks after the second dose. At week 6, spleens were harvested from a subset of the animals (n=4). The remaining animals (n=6) were challenged intranasally while sedated with a mixture of Ketamine and Xylazine with a lethal dose of mouse-adapted influenza virus strain H1N1 A/Puerto Rico/8/1934. Mortality was recorded and individual mouse weight was assessed daily for 20 days post-infection.

Figure 4A:
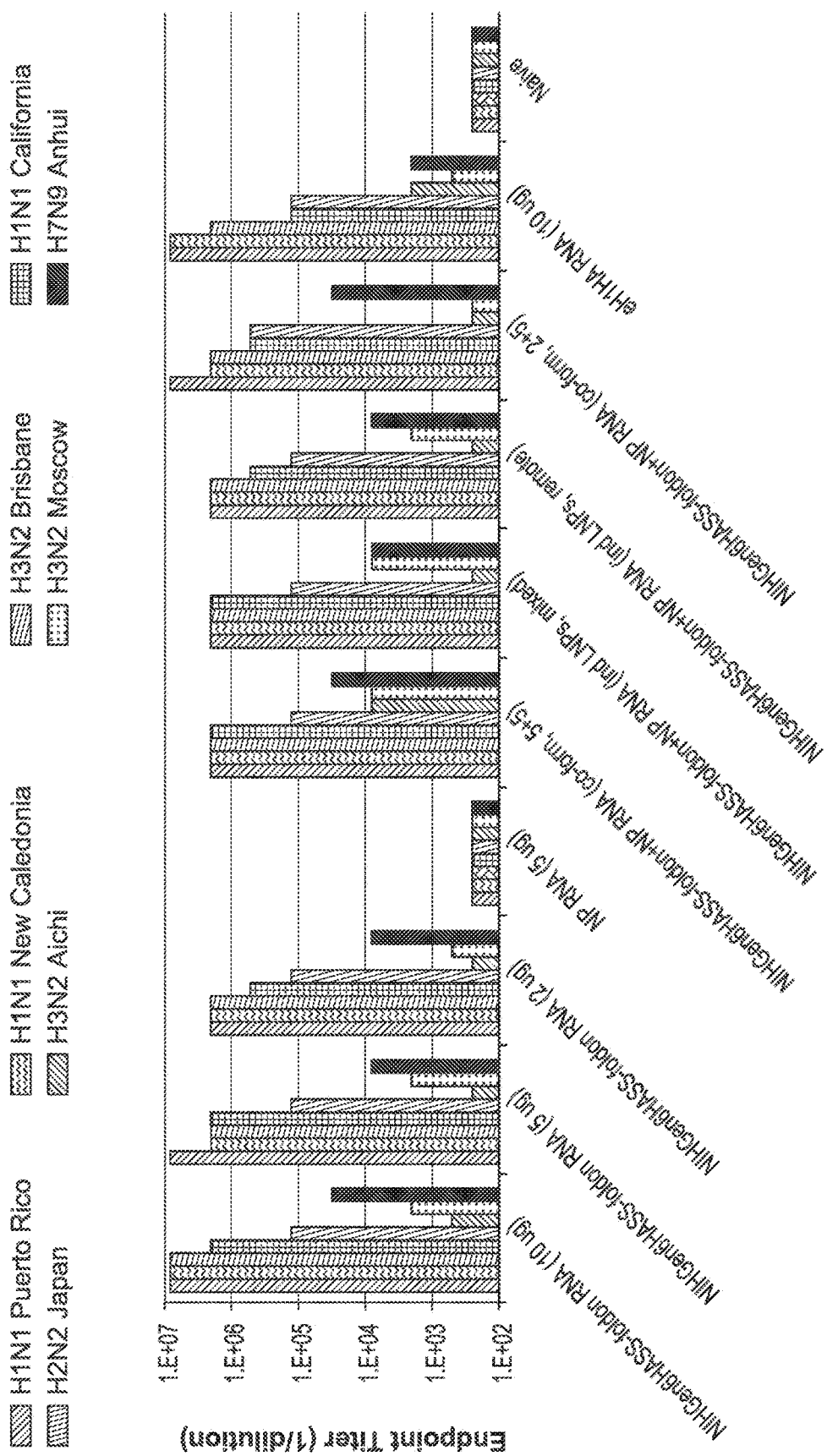
FIGS. 4A-4B depict endpoint titers of the pooled serum from animals vaccinated with the test vaccines.
Figure 4B:
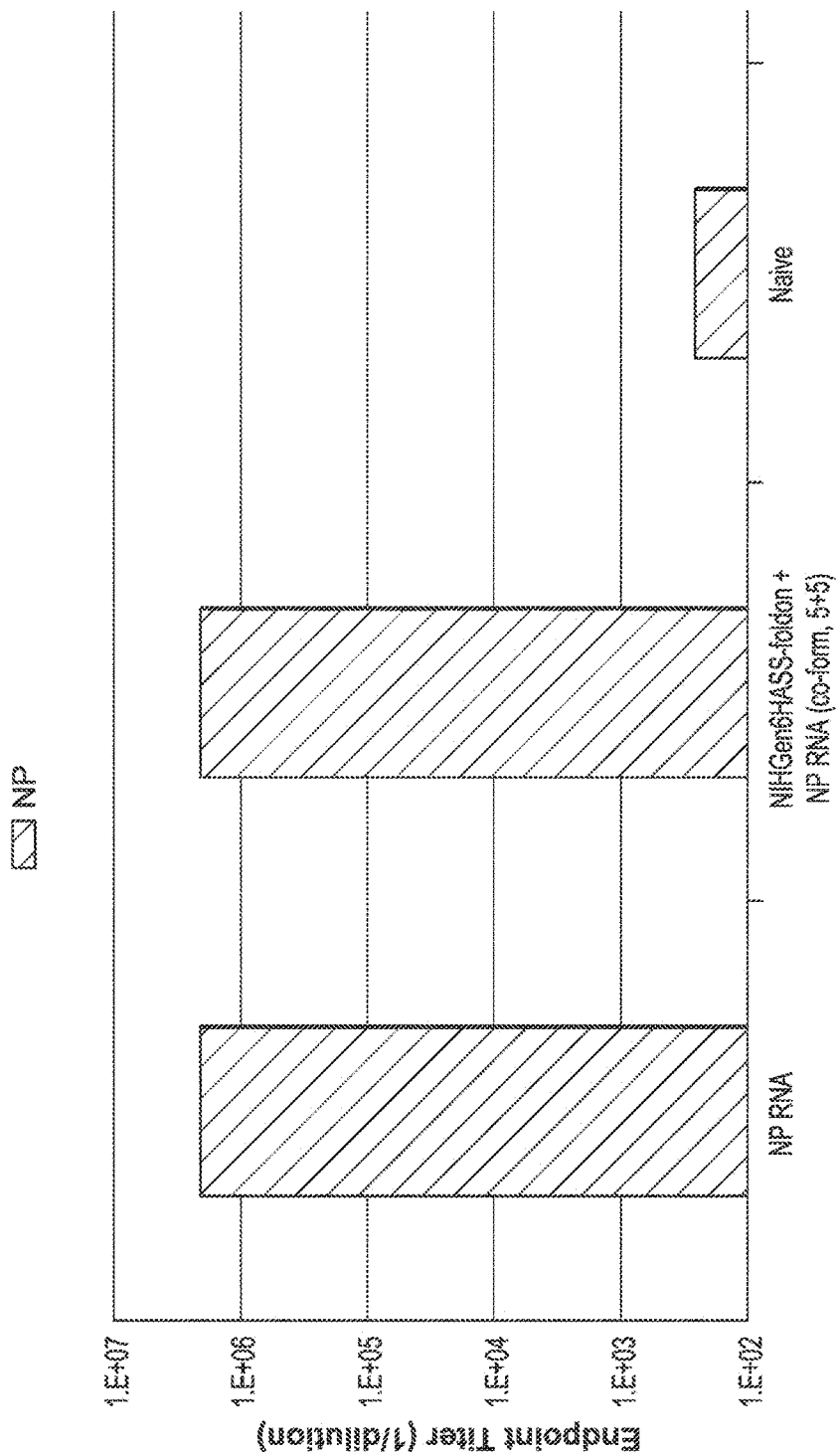

To test the sera for the presence of antibodies capable of binding to hemagglutinin (HA) from a wide variety of influenza strains or nucleoprotein (NP), ELISA plates were coated with 100 ng of the following recombinant proteins obtained from Sino Biological Inc.: Influenza A H1N1 (A/New Caledonia/20/99) HA, cat #11683-V08H; Influenza A H3N2 (A/Aichi/2/1968) HA, cat #11707-V08H; Influenza A H1N1 (A/California/04/2009) HA, cat #11055-V08H; Influenza A H1N1 (A/Puerto Rico/8/34) HA, cat #11684-V08H; Influenza A H1N (A/Brisbane/59/2007) HA, cat #11052-V08H; Influenza A H2N2 (A/Japan/305/1957) HA, cat #11088-V08H; Influenza A H7N9 (A/Anhui/1/2013) HA, cat #40103-V08H, Influenza A H3N2 (A/Moscow/10/99) HA, cat #40154-V08 and Influenza A H3N2 (A/Aichi/2/1968) Nucleoprotein cat #40207-V08B. The ELISA assay was performed and endpoint titers were calculated as described above. FIG. 4 depicts the endpoint titers of the pooled serum from animals vaccinated with the test vaccines. The vaccines tested are shown on the x-axis of FIG. 4A and the binding to HA from each of the different strains of influenza is plotted. The NIHGen6HASS-foldon mRNA vaccine elicited high titers of antibodies that bound all H1, H2 and H7 HAs tested. Combining the NIHGen6HASS-foldon mRNA with one that encodes NP did not negatively affect the observed anti-HA response, regardless of the method of mRNA co-formulation or co-delivery. In serum collected from identical groups from a separate study, a robust antibody response to NP protein was also detected in serum from animals vaccinated with NP mRNA containing vaccines, either NP alone or co-formulated with NIHGen6HASS-foldon mRNA (FIG. 4B).

Figure 5:
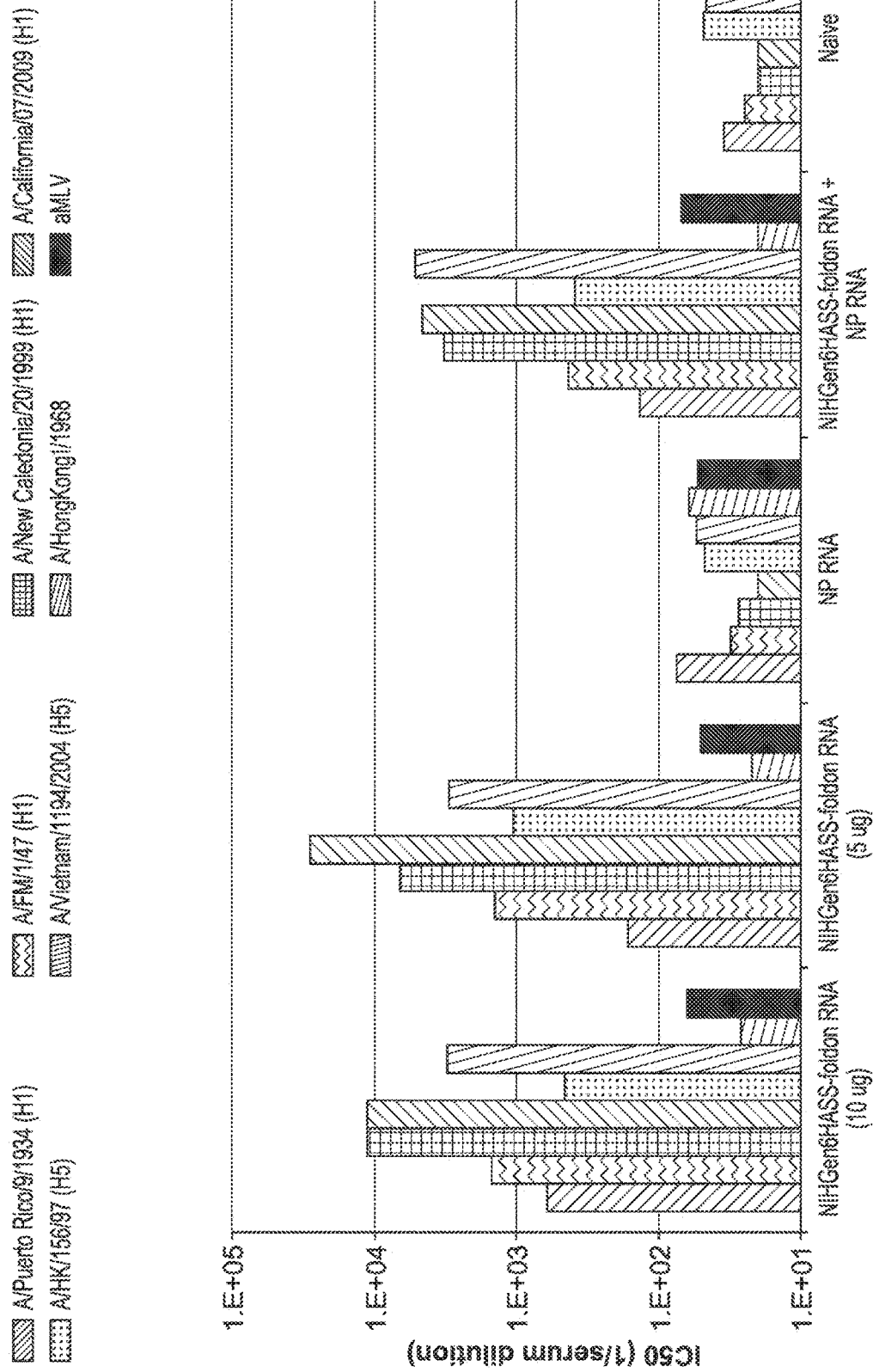
FIG. 5 shows an examination of functional antibody response through an assessment of the ability of serum to neutralize a panel of HA-pseudotyped viruses.
Figure 6:
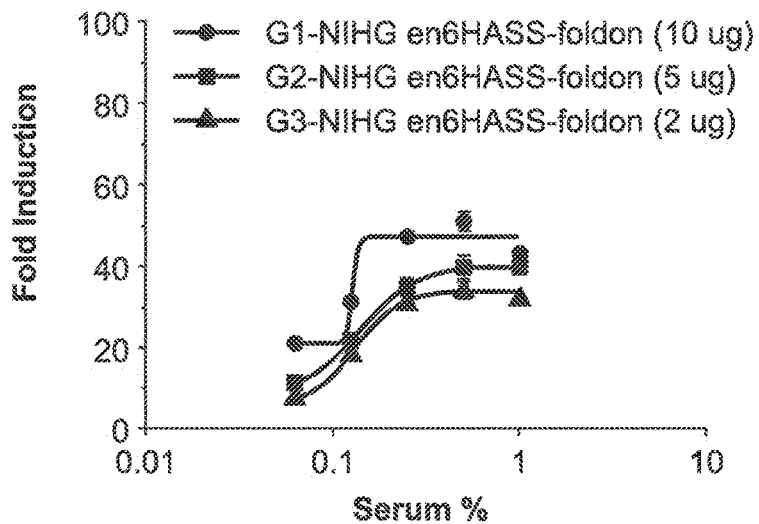
FIG. 6 shows data plotted as fold induction (sample luminescence/background luminescence) versus serum concentration.
Figure 7:
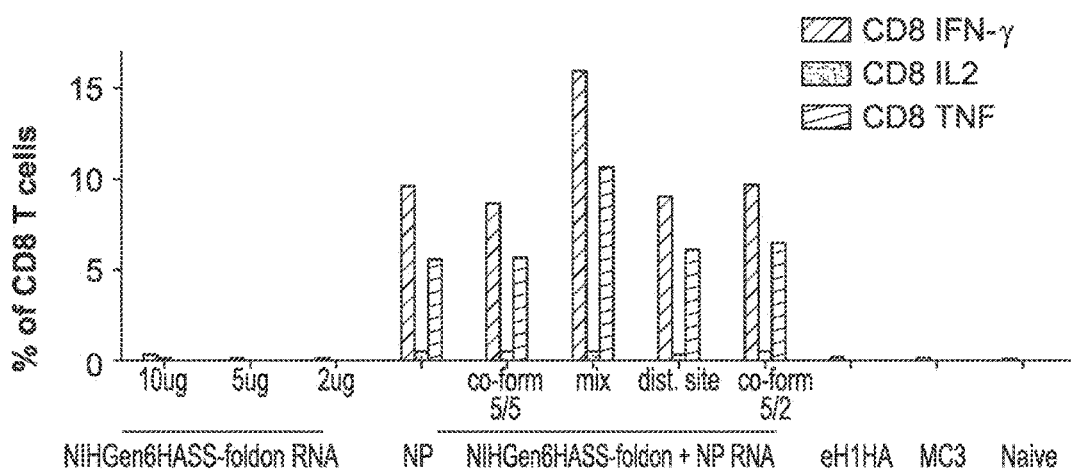
FIG. 7 is a representation of cell-mediated immune responses following mRNA vaccination. Splenocytes were harvested from vaccinated mice and stimulated with a pool of overlapping NP peptides. The % of CD4 or CD8 T cells secreting one of the three cytokines (IFN-γ, IL-2, or TNF-α) is plotted.
Figure 7:
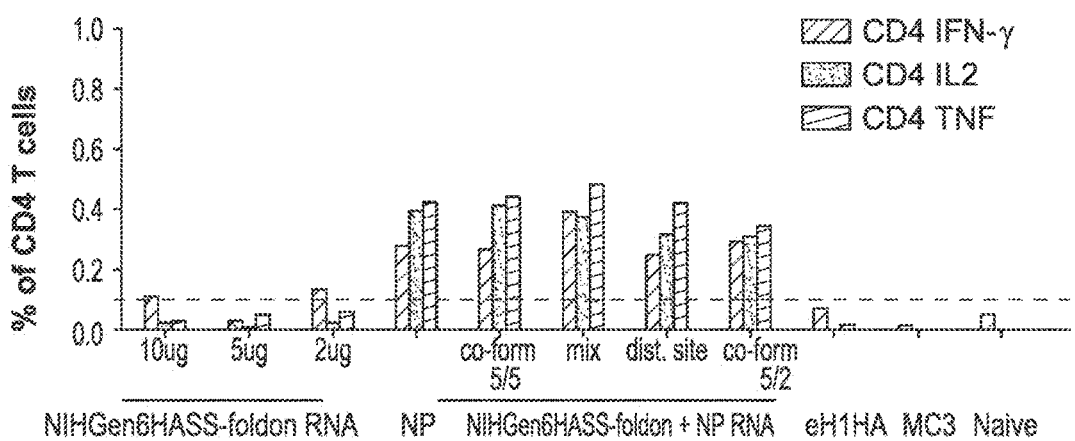
Figure 8:
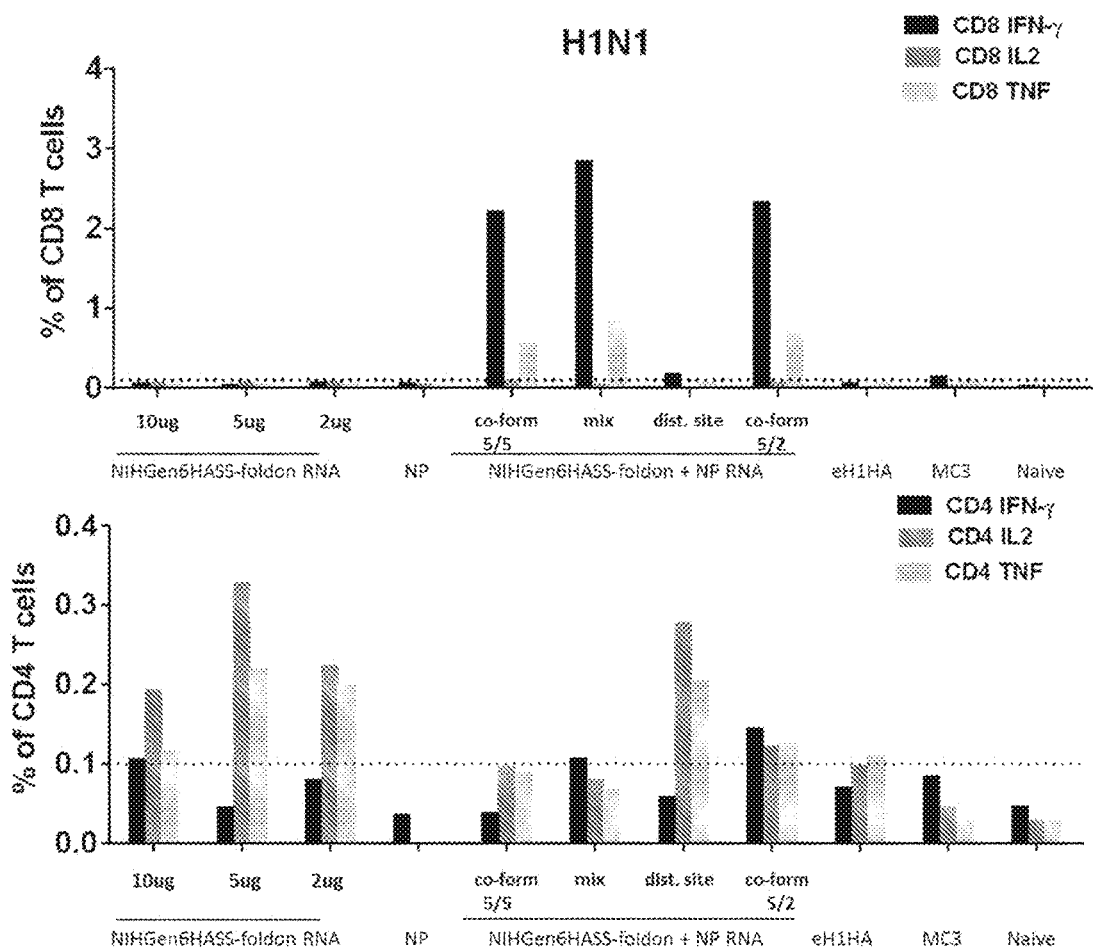
FIG. 8 is a representation of cell-mediated immune responses following mRNA vaccination. Splenocytes were harvested from vaccinated mice and stimulated with a pool of overlapping HA peptides. The % of CD4 or CD8 T cells secreting one of the three cytokines (IFN-γ, IL-2, or TNF-α) is plotted.
Figure 9:
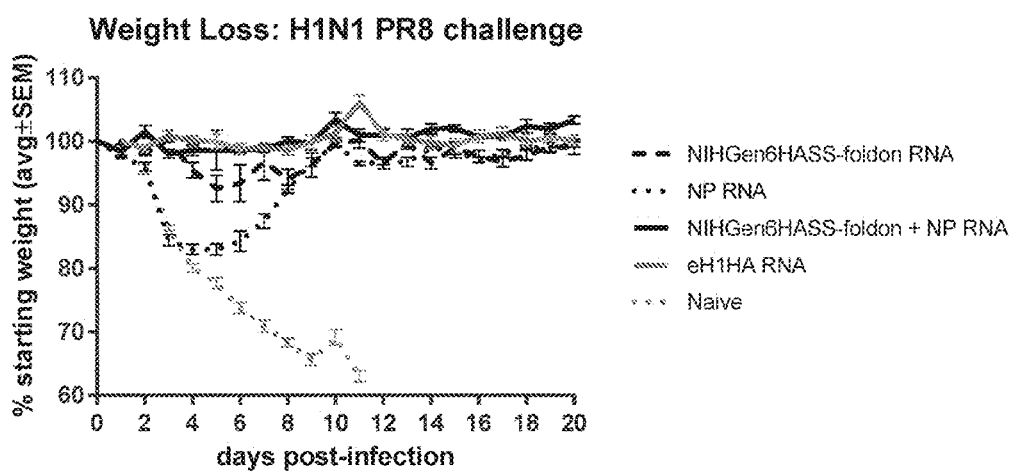
FIG. 9 shows murine weight loss following challenge with a lethal dose of mouse-adapted H1N1 A/Puerto Rico/8/1934. The percentage of weight lost as compared to baseline was calculated for each animal and was averaged across the group. The group average was plotted over time in days. Error bars represent standard error of the mean. Efficacy of the NIHGen6HASS-foldon+NP combination vaccine was better than that of either the NIHGen6HASS-foldon or NP mRNA vaccine alone.
Figure 10:
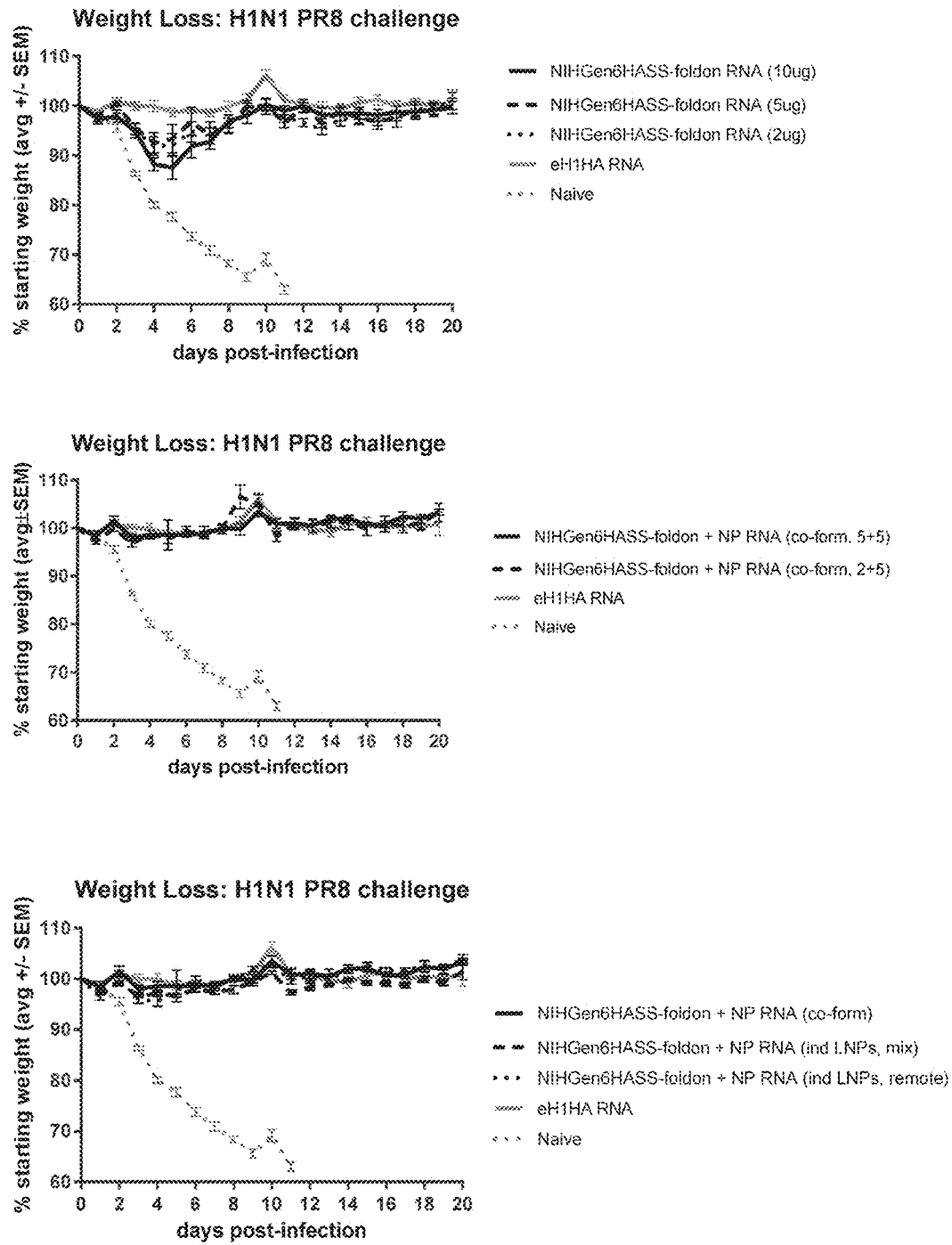
FIG. 10 shows vaccine efficacy was similar at all vaccine doses, as well as with all co-formulation and co-delivery methods assessed. Following challenge with a lethal dose of mouse-adapted H1N1 A/Puerto Rico/8/1934, the percentage of weight lost as compared to baseline was calculated for each animal and was averaged across the group. The group average was plotted over time in days. Error bars represent standard error of the mean.

To probe the functional antibody response, the ability of serum to neutralize a panel of HA-pseudotyped viruses was assessed (FIG. 5). Briefly, 293 cells were co-transfected with a replication-defective retroviral vector containing a firefly luciferase gene, an expression vector encoding a human airway serine protease, and expression vectors encoding influenza hemagglutinin (HA) and neuraminidase (NA) proteins. The resultant pseudoviruses were harvested from the culture supernatant, filtered, and titered. Serial dilutions of serum were incubated in 96 well plates at 37° C. for one hour

TABLE 3

| Test Vaccines | | | | |
|---|---|---|---|---|
| Group # | Antigen | Antigen dose | Formulation | Volume, Route |
| 1 | NIHGen6HASS-foldon RNA | 10 µg | MC3 | 100 µl, i.m. |
| 2 | NIHGen6HASS-foldon RNA | 5 µg | MC3 | 100 µl, i.m. |
| 3 | NIHGen6HASS-foldon RNA | 2 µg | MC3 | 100 µl, i.m. |
| 4 | NP RNA | 5 µg | MC3 | 100 µl, i.m. |
| 5 | NIHGen6HASS-foldon RNA + NP RNA | 5 µg of each RNA mixed, then formulated | MC3 | 100 µl, i.m. |
| 6 | NIHGen6HASS-foldon RNA + NP RNA | 5 µg of each RNA formulated, then mixed | MC3 | 100 µl, i.m. |
| 7 | NIHGen6HASS-foldon RNA + NP RNA | 5 µg of each RNA formulated and injected into separate legs | MC3 | 100 µl, i.m. |
| 8 | NIHGen6HASS-foldon RNA + NP RNA | 5 µg of NP + 2 µg of NIHGen6HASS-foldon RNA mixed, then formulated | MC3 | 100 µl, i.m. |
| 9 | eH1HA RNA | 10 µg | MC3 | 100 µl, i.m. |
| 10 | MC3 | 0 µg | MC3 | 100 µl, i.m. |
| 11 | Naïve | 0 µg | None | None | with pseudovirus stocks (30,000-300,000 relative light units per well) before 293 cells were added to each well. The cultures were incubated at 37° C. for 72 hours, luciferase substrate and cell lysing reagents were added, and relative light units (RLU) were measured on a luminometer. Neutralization titers are expressed as the reciprocal of the serum dilution that inhibited 50% of pseudovirus infection (IC50).

For each sample tested (listed along the x-axis), each bar represents the IC50 for neutralization of a different virus pseudotype. While the serum from naïve or NP RNA vaccinated mice was unable to inhibit pseudovirus infection, the serum from mice vaccinated with 10 µg or 5 µg of NIHGen6HASS-foldon mRNA or with a combination of NIHGen6HASS-foldon and NP mRNAs neutralized, to a similar extent, all H1 and H5 virus pseudotypes tested.

Figure 11A:
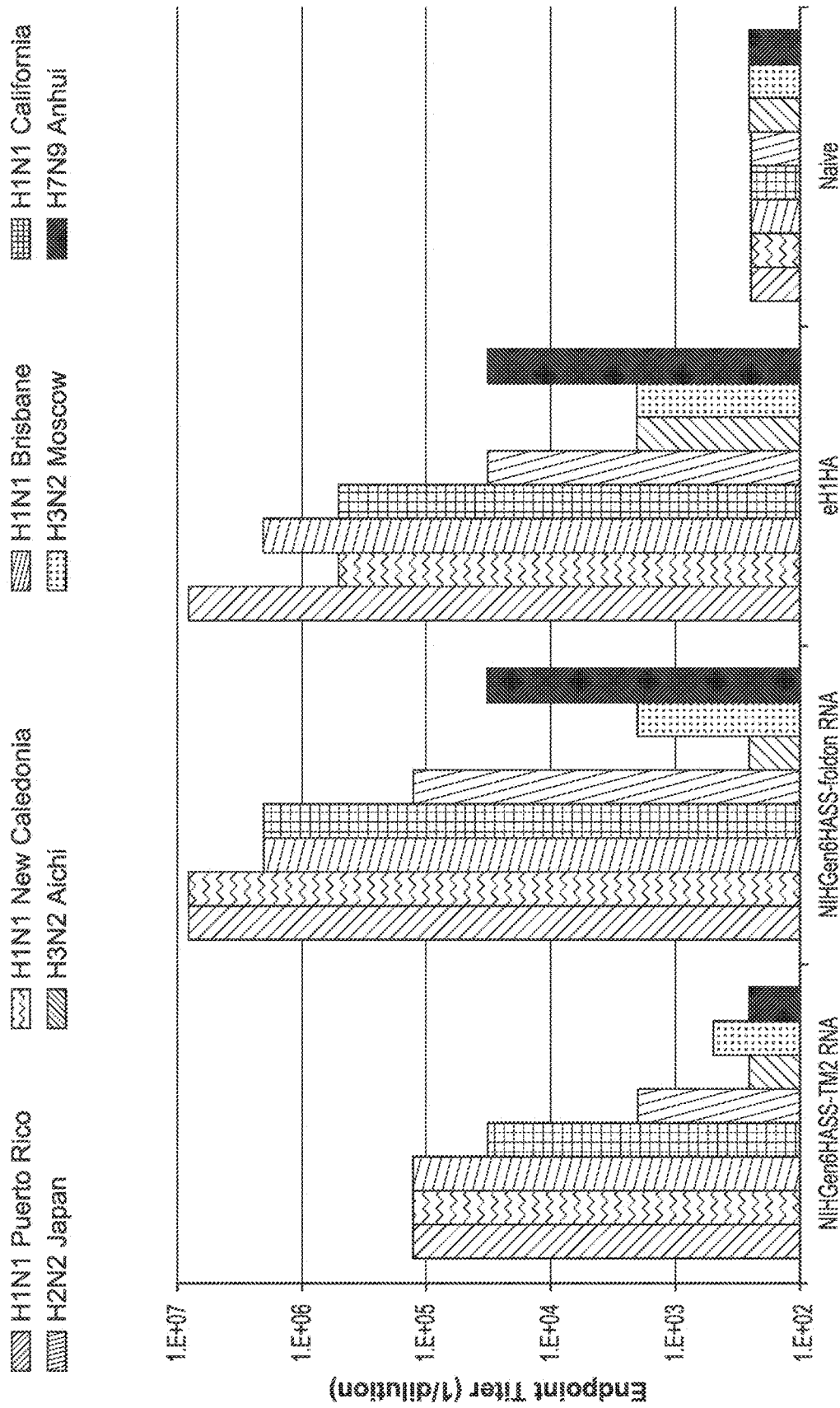
FIG. 11A depicts the endpoint titers of the pooled serum from animals vaccinated with the test vaccines.
Figure 11B:
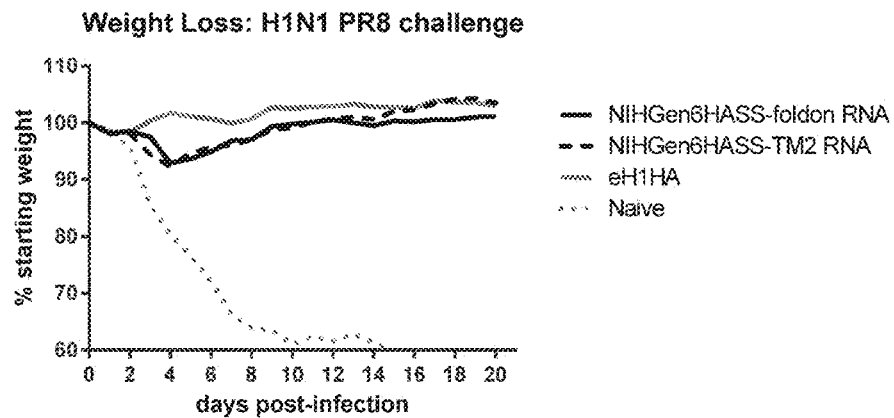
FIG. 11B shows efficacy of the test vaccines (NIHGen6HASS-foldon and NIHGen6HASS-TM2) is similar. Following challenge with a lethal dose of mouse-adapted H1N1 A/Puerto Rico/8/1934, the percentage of group weight lost as compared to baseline was calculated and plotted over time in days.

The ability of NIHGen6HASS-foldon antisera to mediate antibody-dependent cell cytotoxicity (ADCC) surrogate activity in vitro was also assessed. Briefly, serially titrated mouse serum samples were incubated with A549 cells stably expressing HA from H1N1 A/Puerto Rico/8/1934 on the cell surface. Subsequently, ADCC Bioassay Effector cells (Promega, mouse FcgRIV NFAT-Luc effector cells) were added to the serum/target cell mixture. Approximately 6 hours later, Bio-glo reagent (Promega) was added to sample wells and luminescence was measured. Data was plotted as fold induction (sample luminescence/background luminescence) versus serum concentration (FIG. 6). When incubated with the appropriate target cells, serum from NIHGen6HASS-foldon mRNA vaccinated mice was able to stimulate the surrogate ADCC effector cell line, suggesting that the vaccine may induce antibodies capable of mediating in vivo ADCC activity.

Three weeks after the administration of the second vaccine dose, spleens were harvested from a subset of animals in each group and splenocytes from animals in the same group were pooled. Splenic lymphocytes were stimulated with a pool of HA or NP peptides, and IFN-γ, IL-2 or TNF-α production was measured by intracellular staining and flow cytometry. FIG. 7 is a representation of responses following stimulation with a pool of NP peptides, and FIG. 8 is a representation of responses following stimulation with a pool of H1 HA peptides. Following vaccination with NP mRNA, either in the presence or absence of NIHGen6HASS-foldon mRNA, antigen-specific CD4 and CD8 T cells were found in the spleen. Following vaccination with NIHGen6HASS-foldon RNA or delivery of NIHGen6HASS-foldon and NP RNAs to distal injections sites (dist. site), only HA-specific CD4 cells were observed. However, when NIHGen6HASS-foldon and NP RNAs were co-administered to the same injection site (co-form, mix), an HA-specific CD8 T cell response was detected.

Following lethal challenge with mouse-adapted H1N1 A/Puerto Rico/8/1934, all naïve animals succumbed to infection by day 12 post-infection (FIG. 9). In contrast, all animals vaccinated with NIHGen6HASS-foldon mRNA, NP mRNA, any combination of NIHGen6HASS-foldon and NP mRNAs, or eH1HA mRNA survived the challenge. As seen in FIG. 9, although there was no mortality, mice that were vaccinated with an H3N2 NP mRNA and challenged with H1N1 virus lost a significant amount (~15%) of weight prior to recovery. Those vaccinated with NIHGen6HASS-foldon RNA also lost ~5% body weight. In contrast, mice vaccinated with a combination of NIHGen6HASS-foldon and NP mRNAs appeared to be completely protected from lethal influenza virus challenge, similar to those vaccinated with mRNA expressing an HA antigen homologous to that of the challenge virus (eH1HA). Vaccine efficacy was similar at all vaccine doses, as well as with all co-formulation and co-delivery methods assessed (FIG. 10).

Influenza A Challenge #2

This study was designed to test the immunogenicity and efficacy in mice of candidate influenza virus vaccines. Animals tested were 6-8 week old female BALB/c mice obtained from Charles River Laboratories. Test vaccines included the following mRNAs formulated in MC3 LNP: NIHGen6HASS-foldon mRNA (based on Yassine et al. *Nat. Med.* 2015 September; 21(9):1065-70) and NIHGen6HASS-TM2 mRNA. Control animals were vaccinated with an mRNA encoding the ectodomain of the HA from H1N1 A/Puerto Rico/8/1934 (eH1HA, positive control) or were not vaccinated (naïve).

At week 0 and week 3, animals were immunized intramuscularly (IM) with a total volume of 100 μL of each test vaccine, which was administered in a 50 μL immunization to each quadricep. Candidate influenza virus vaccines evaluated in this study were described above and outlined in the table below. Sera were collected from all animals two weeks after the second dose. At week 6, all animals were challenged intranasally while sedated with a mixture of Ketamine and Xylazine with a lethal dose of mouse-adapted influenza virus strain H1N1 A/Puerto Rico/8/1934. Mortality was recorded and group mouse weight was assessed daily for 20 days post-infection.

TABLE 4

Test Vaccines

| Group # | Antigen | Antigen dose | Formulation | Volume, Route |
|---|---|---|---|---|
| 1 | NIHGen6HASS-foldon RNA | 5 μg | MC3 | 100 μl, i.m. |
| 2 | NIHGen6HASS-foldon-TM2 RNA | 5 μg | MC3 | 100 μl, i.m. |
| 3 | eH1HA RNA | 10 μg | MC3 | 100 μl, i.m. |
| 4 | Naïve | 0 μg | None | None |

To test the sera for the presence of antibody capable of binding to hemagglutinin (HA) from a wide variety of influenza strains, ELISA plates were coated with 100 ng of the following recombinant HAs obtained from Sino Biological Inc.: Influenza A H1N1 (A/New Caledonia/20/99), cat #11683-V08H; Influenza A H3N2 (A/Aichi/2/1968), cat #11707-V08H; Influenza A H1N1 (A/California/04/2009) cat #11055-V08H; Influenza A H1N1 (A/Puerto Rico/8/34) cat #11684-V08H; Influenza A H1N1 (A/Brisbane/59/2007), cat #11052-V08H; Influenza A H2N2 (A/Japan/305/1957) cat #11088-V08H; Influenza A H7N9 (A/Anhui/1/2013) cat #40103-V08H and Influenza A H3N2 (A/Moscow/10/99) cat #40154-V08. The ELISA assay was performed and endpoint titers were calculated as described above. FIG. 11A depicts the endpoint titers of the pooled serum from animals vaccinated with the test vaccines. The vaccines tested are shown on the x-axis and the binding to HA from each of the different strains of influenza is plotted. The NIHGen6HASS-foldon mRNA vaccine elicited high titers of antibodies that bound all H1, H2 and H7 HAs tested. The binding titers from NIHGen6HASS-TM2 mRNA vaccinated mice were reduced as compared to those from NIHGen6HASS-foldon mRNA vaccinated mice.

Following lethal challenge with mouse-adapted H1N1 A/Puerto Rico/8/1934, all naïve animals succumbed to infection by day 16 post-infection (FIG. 11B). In contrast, all animals vaccinated with NIHGen6HASS-foldon mRNA, NIHGen6HASS-TM2 mRNA, or eH1HA RNA survived the challenge. As shown in FIG. 11B, the efficacy of the NIHGen6HASS-TM2 vaccine was equivalent to that of the NIHGen6HASS-foldon vaccine.

Influenza A Challenge #3

In this example, two animal studies and assays were carried out to evaluate the immune response to influenza virus consensus hemagglutinin (HA) vaccine antigens delivered using an mRNA/LNP platform. The purpose of these studies was to evaluate the ability of consensus HA mRNA vaccine antigens to elicit cross-protective immune responses in the mouse.

To generate consensus HA sequences, 2415 influenza A serotype H1 HA sequences were obtained from the NIAID Influenza Research Database (IRD) (Squires et al., *Influenza Other Respir Viruses*. 2012 November; 6(6): 404-416) through the web site at www.fludb.org. After removal of duplicate sequences and lab strains, 2385 entries remained, including 1735 H1 sequences from pandemic H1N1 strains (pH1N1) and 650 from seasonal H1N1 strains (sH1N1). Pandemic and seasonal H1 sequences were separately aligned and a consensus sequence was generated for each group using the Matlab 9.0 Bioinformatics toolbox (MathWorks, Natick, Mass.). Sequence profiles were generated for both groups separately using a modified Seq2Logo program (Thomsen et al., *Nucleic Acids Res.* 2012 July; 40 (Web Server issue):W281-7).

Animals tested were 6-8 week old female BALB/c mice obtained from Charles River Laboratories. Test vaccines included the following mRNAs formulated in MC3 LNP: ConH1 and ConH3 (based on Webby et al., *PLoS One.* 2015 Oct. 15; 10(10):e0140702); Cobra_P1 and Cobra_X3 (based on Carter et al., *J Virol.* 2016 Apr. 14; 90(9):4720-34); MRK_pH1_Con and MRK_sH1_Con (pandemic and seasonal consensus sequences described above); and each of the above mentioned six antigens with a ferritin fusion sequence for potential particle formation.

Controls included: MC3 (control for effects of LNP); Naïve (unvaccinated animals); and vaccination with eH1HA RNA, which encode the ectodomain of HA from strain H1N1 A/PR/8/34 (positive control for the virus challenge).

At week 0 and week 3, animals were immunized intramuscularly (IM) with a total volume of 100 µL of each test vaccine, which was administered in a 50 µL immunization to each quadricep. Candidate influenza virus vaccines evaluated in this study were described above and are outlined in the table below. Sera were collected from all animals two weeks after the second dose (week 5). At week 6, the animals were challenged intranasally while sedated with a mixture of Ketamine and Xylazine with a lethal dose of mouse-adapted influenza virus strain H1N1 A/Puerto Rico/ 8/1934 (PR8). Mortality was recorded and group weight was assessed daily for 20 days post-infection.

TABLE 5

Test Vaccines

| Group # | Antigen | Antigen dose | Formulation | Volume, Route |
|---|---|---|---|---|
| 1 | Con_H1 RNA | 10 µg | MC3 | 100 µl, i.m. |
| 2 | Con_H3 RNA | 10 µg | MC3 | 100 µl, i.m. |
| 3 | Merck_pH1_Con RNA | 10 µg | MC3 | 100 µl, i.m. |
| 4 | Merck_sH1_Con RNA | 10 µg | MC3 | 100 µl, i.m. |
| 5 | Cobra_P1 RNA | 10 µg | MC3 | 100 µl, i.m. |
| 6 | Cobra_X3 RNA | 10 µg | MC3 | 100 µl, i.m. |
| 7 | ConH1_ferritin RNA | 10 µg | MC3 | 100 µl, i.m. |
| 8 | ConH3_ferritin RNA | 10 µg | MC3 | 100 µl, i.m. |
| 9 | Merck_pH1_Con_ferritin RNA | 10 µg | MC3 | 100 µl, i.m. |
| 10 | Merck_sH1_Con_ferritin RNA | 10 µg | MC3 | 100 µl, i.m. |
| 11 | Cobra_P1_ferritin RNA | 10 µg | MC3 | 100 µl, i.m. |
| 12 | Cobra_X3_ferritin RNA | 10 µg | MC3 | 100 µl, i.m. |
| 13 | eH1HA | 10 µg | MC3 | 100 µl, i.m. |
| 14 | MC3 | 0 µg | MC3 | 100 µl, i.m. |
| 15 | Naïve | 0 µg | None | None |

Figure 12A:
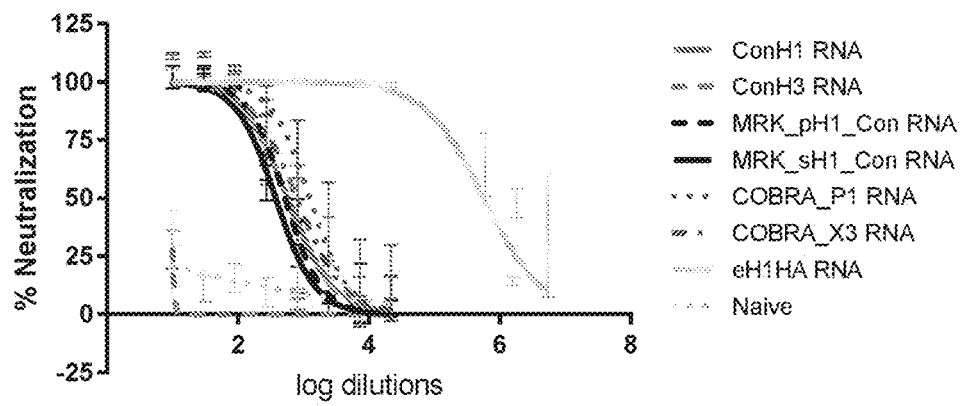
FIG. 12A shows that serum from mice immunized with mRNA encoding consensus HA antigens from the H1 subtype was able to detectably neutralize the PR8 luciferase virus.
Figure 12B:
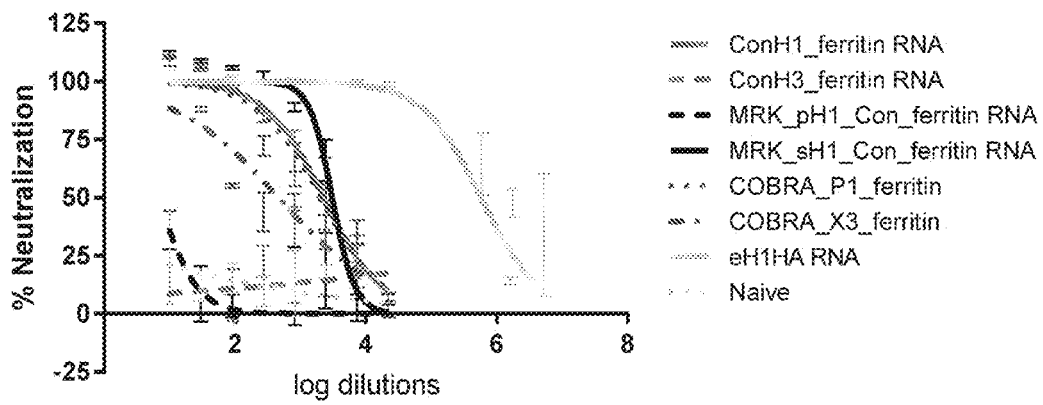
FIG. 12B shows that serum from mice immunized with mRNA encoding H1 subtype consensus HA antigens with a ferritin fusion sequence was able to detectably neutralize the PR8 luciferase virus, except for the Merck_pH1_Con_ferritin mRNA, while serum from mice vaccinated with an mRNA encoding the consensus H3 antigen with a ferritin fusion sequence was not able to neutralize the PR8 luciferase virus.
Figure 13A:
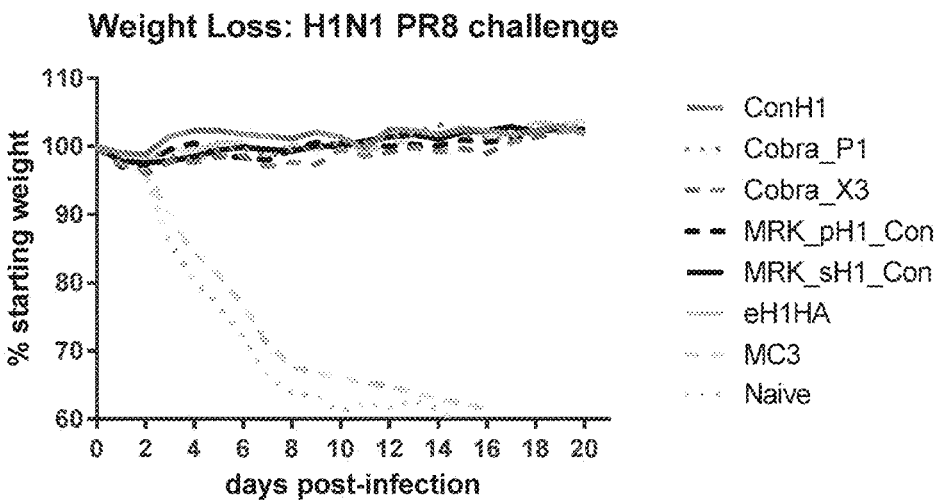
FIGS. 13A-13B show murine weight loss following challenge with a lethal dose of mouse-adapted H1N1 A/Puerto Rico/8/1934. The percentage of group weight lost as compared to baseline was calculated and plotted over time in days.
Figure 13B:
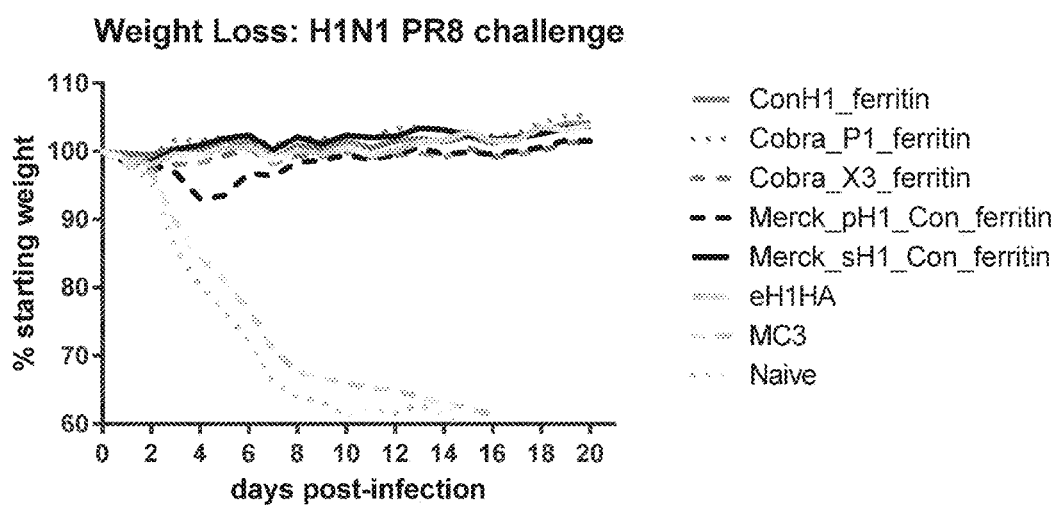

To test the ability of the serum antibodies to neutralize the challenge virus strain, a microneutralization assay using a modified PR8 virus with a *Gaussia* luciferase reporter gene (Pan et al., *Nat Commun.* 2013; 4:2369) was performed. Briefly, PR8 luciferase virus was diluted in virus diluent with TPCK-treated trypsin. Serum samples were diluted 1:10 and then serially diluted 3-fold in 96-well cell culture plates. 50 µL of each diluted serum sample and an equal volume of diluted virus were mixed in the well and incubated at 37° C. with 5% $CO_2$ for 1 hr before 100 µL of MDCK cells at 1.5×10^5 cells/mL were added. Plates were then incubated at 37° C. with 5% $CO_2$ for 72 hrs. Luminescence signal was read with a *Gaussia* Luciferase Glow Assay Kit (Pierce) on an EnVision reader (Perkin Elmer). As shown in FIG. 12A, serum from mice immunized with mRNA encoding consensus HA antigens from the H1 subtype was able to detectably neutralize the PR8 luciferase virus, even though the HA sequences of these antigens were 8-19% different from that of the PR8 strain. The HA sequence-matched antigen (eH1HA) elicited a much higher serum neutralizing antibody response against this virus. Serum from mice vaccinated with RNA encoding the consensus H3 antigen (ConH3), in contrast, was not able to neutralize the PR8 luciferase virus, suggesting that the consensus sequences from different subtypes (H1 and H3, for example) may not cross-react. Similarly, serum from mice immunized with mRNA encoding H1 subtype consensus HA antigens with a ferritin fusion sequence was able to detectably neutralize the PR8 luciferase virus, except for the Merck_pH1_Con_ferritin mRNA, while serum from mice vaccinated with an mRNA encoding the consensus H3 antigen with a ferritin fusion sequence was not able to neutralize the PR8 luciferase virus (FIG. 12B). Consistent with the serum neutralization data, mice immunized with the consensus H1 HA antigens (with or without ferritin fusion) survived the lethal PR8 virus challenge and showed no weight loss, except for the Merck_pH1_Con_ferritin mRNA group, while mice in the ConH3, naïve and LNP only control groups rapidly lost weight upon challenge (FIG. 13). Mice immunized with Merck_pH1_Con_ferritin mRNA survived the lethal PR8 virus challenge and showed 5-10% weight loss, suggesting that partial protection may be mediated by mechanism(s) other than virus neutralization.

Figure 14:
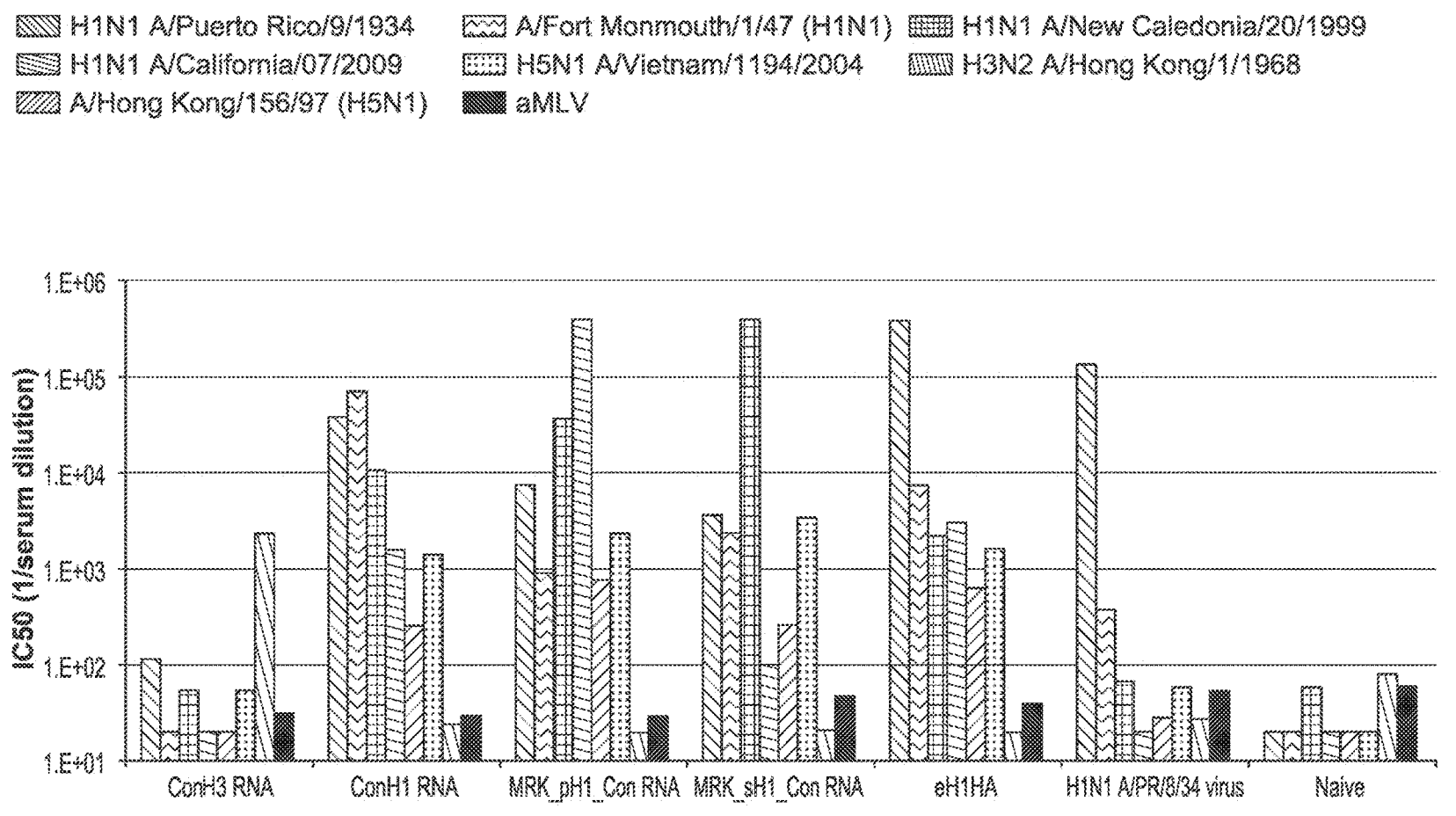

To assess the breadth of the serum neutralizing activity elicited by the consensus HA antigens, neutralization assays were performed on a panel of pseudoviruses as described above (FIG. 14). As expected, serum from mice immunized with influenza virus H1N1 A/Puerto Rico/8/1934 (from studies described in Example 12) was only able to neutralize a matched pseudovirus strain (PR8). In contrast, serum from mice immunized with the consensus H1 HA antigens, as well as the eH1HA antigen, were able to neutralize a panel of diverse group 1 pseudoviruses, including strains from subtypes H1 and H5, but not a strain from group 2 (subtype H3). Consistently, serum from mice immunized with the consensus H3 HA antigen was able to neutralize a strain from group 2 (subtype H3) but not any of the group 1 pseudoviruses.

Influenza B Challenge

This study was designed to test the immunogenicity and efficacy in mice of candidate influenza virus vaccines. Animals tested were 6-8 week old female BALB/c mice obtained from Charles River Laboratories. Test vaccines included the following mRNAs formulated in MC3 LNP: B/Phuket/3073/2013 sHA (soluble HA), B/Phuket/3073/2013 mHA (full-length HA with membrane anchor), B/Brisbane/60/2008 sHA, B/Victoria/02/1987 sHA, B/Victoria/02/1987 mHA, B/Yamagata/16/1988 mHA, or BHA10 (HA stem design). Control animals were vaccinated with a nonlethal dose of mouse-adapted B/Ann Arbor/1954 (positive control) or empty MC3 LNP (to control for effects of the LNP) or were not vaccinated (naïve).

At week 0 and week 3, animals were immunized intramuscularly (IM) with a total volume of 100 µL of each test vaccine, which was administered in a 50 µL immunization to each quadricep. Candidate influenza virus vaccines evaluated in this study were described above and are outlined in the table below. Sera were collected from all animals two weeks after the second dose. At week 6, all animals (n=10 per group) were challenged intranasally while sedated with a mixture of Ketamine and Xylazine with a lethal dose of mouse-adapted influenza virus strain B/Ann Arbor/1954. Mortality was recorded and group mouse weight was assessed daily for 20 days post-infection.

Each of the sequences described herein encompasses a chemically modified sequence or an unmodified sequence which includes no nucleotide modifications.

TABLE 6

Test Vaccines

| Group # | Antigen | Antigen dose | Formulation | Volume, Route |
|---|---|---|---|---|
| 1 | B/Phuket/3073/2013 sHA RNA | 10 µg | MC3 | 100 µl, i.m. |
| 2 | B/Phuket/3073/2013 mHA RNA | 10 µg | MC3 | 100 µl, i.m. |
| 3 | B/Brisbane/60/2008 sHA RNA | 10 µg | MC3 | 100 µl, i.m. |
| 4 | B/Victoria/02/1987 sHA RNA | 10 µg | MC3 | 100 µl, i.m. |
| 5 | B/Victoria/02/1987 mHA RNA | 10 µg | MC3 | 100 µl, i.m. |
| 6 | B/Yamagata/16/1988 mHA RNA | 10 µg | MC3 | 100 µl, i.m. |
| 7 | BHA10 RNA | 10 µg | MC3 | 100 µl, i.m. |
| 8 | MC3 | 0 µg | MC3 | 100 µl, i.m. |
| 9 | Naive | 0 µg | None | 100 µl, i.m. |
| 10 | B/Ann Arbor/1954 | 0.1 LD90 | None | 20 µl, i.n. |

Figure 15A:
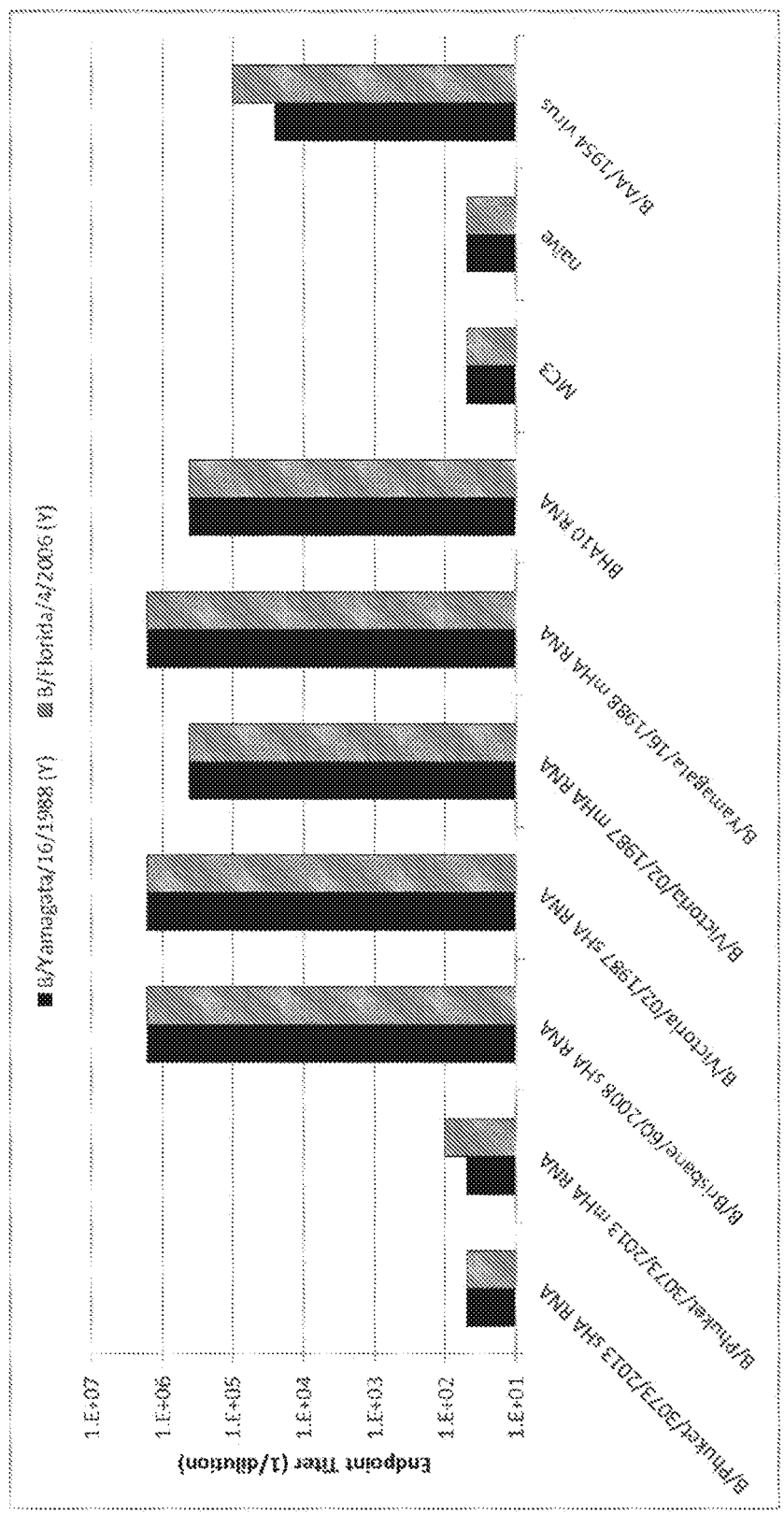
FIG. 15A depicts the ELISA endpoint anti-HA antibody titers of the pooled serum from animals vaccinated with the test vaccines.

FIG. 15A depicts the ELISA endpoint anti-HA antibody titers of the pooled serum from animals vaccinated with the test vaccines. The vaccines tested are shown on the x-axis and the binding to HA from each of the different strains of influenza is plotted. All vaccines tested, except for those derived from B/Phuket/3073/2013 were immunogenic, and serum antibody bound to HA from both B/Yamagata/16/1988 (Yamagata lineage) and B/Florida/4/2006 (Victoria lineage).

Figure 15B:
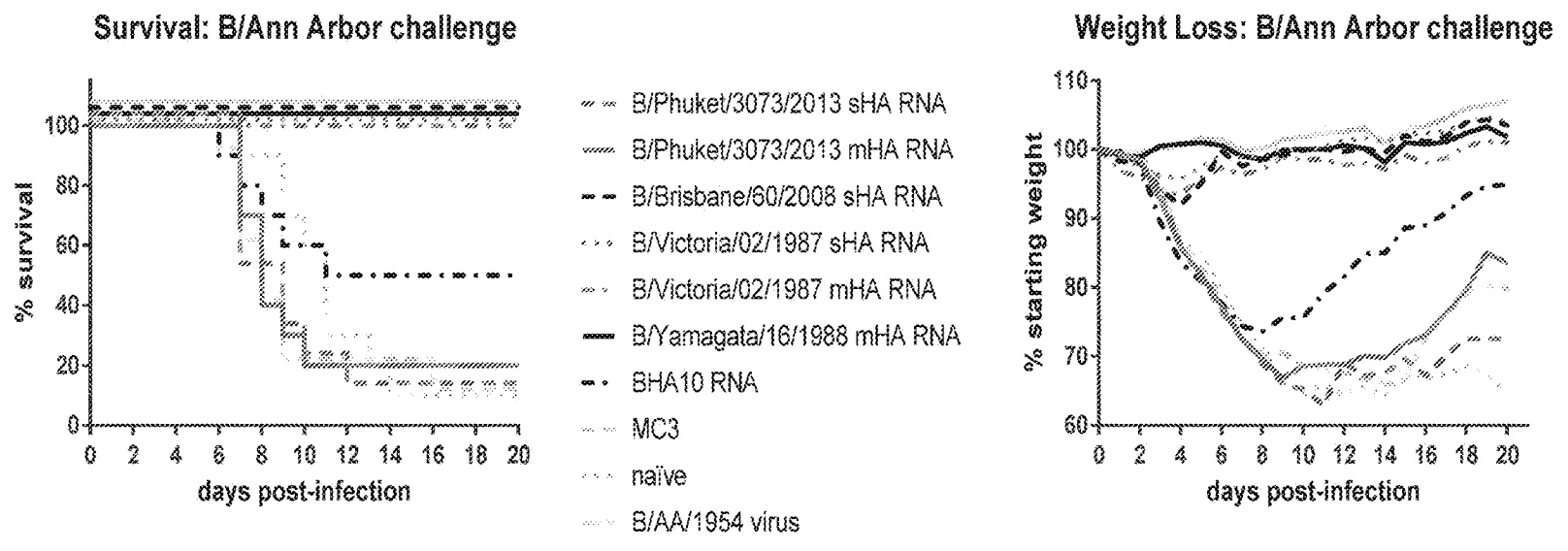

Following lethal challenge with mouse-adapted B/Ann Arbor/1954, 90% of MC3-vaccinated and naïve animals succumbed to infection by day 16 post-infection (FIG. 15B). The B/Phuket/3073/2013 sHA and mHA mRNA vaccines showed no efficacy against lethal challenge, and the BHA10 stem mRNA vaccine protected only half of the animals. All other vaccines tested protected mice completely from mortality (FIG. 15B), but only the B/Yamagata/16/1988 mHA RNA vaccine was able to prevent lethality and weight loss in animals challenged with a heterologous virus strain (FIG. 15B).

Example 14: Non-Human Primate Immunogenicity

This study was designed to test the immunogenicity in rhesus macaques of candidate influenza virus vaccines. Test vaccines included the following mRNAs formulated in MC3 LNP: NIHGen6HASS-foldon mRNA (based on Yassine et al. *Nat. Med.* 2015 September; 21(9):1065-70) and NP mRNA encoding NP protein from an H3N2 influenza strain.

Animals in Group 1 had been previously vaccinated with seasonal inactivated influenza vaccine (FLUZONE®) and were boosted intramuscularly (IM) at day 0 with 300 µg of NIHGen6HASS-foldon mRNA. Animals in Groups 2 and 3 were influenza naïve at the study start and were vaccinated at days 0, 28 and 56 with 300 µg of NIHGen6HASS-foldon mRNA or 300 µg of NP mRNA, respectively. Serum was collected from all animals prior to the study start (day −8) as well as at days 14, 28, 42, 56, 70, 84, 112, 140 and 168.

Figure 16A:
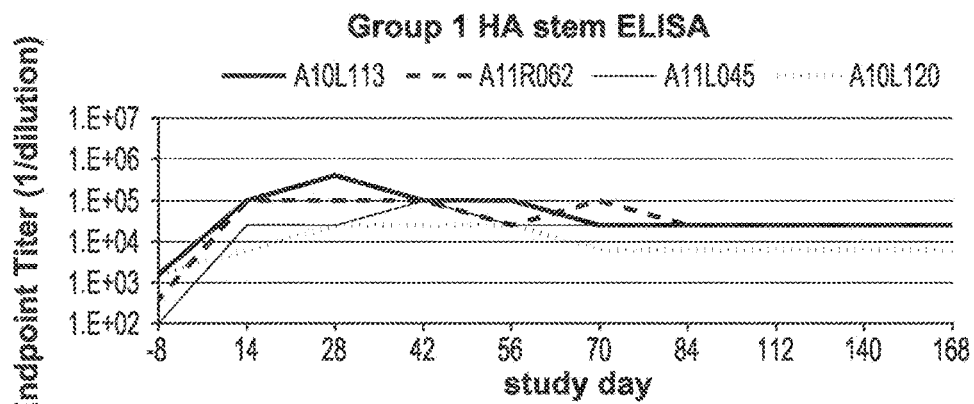
FIGS. 16A-16C show data depicting the NIHGen6HASS-foldon vaccine's robust antibody response as measured by ELISA assay (plates coated with recombinantly-expressed NIHGen6HASS-foldon [HA stem] or NP proteins).
Figure 16B:
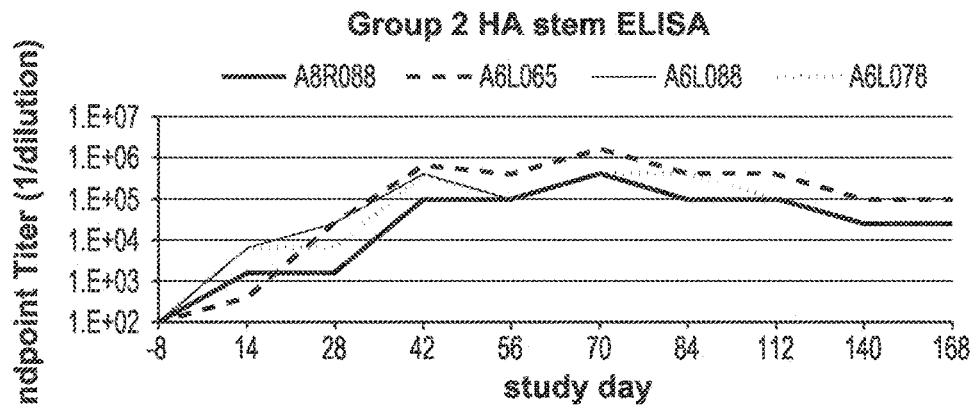
Figure 16C:
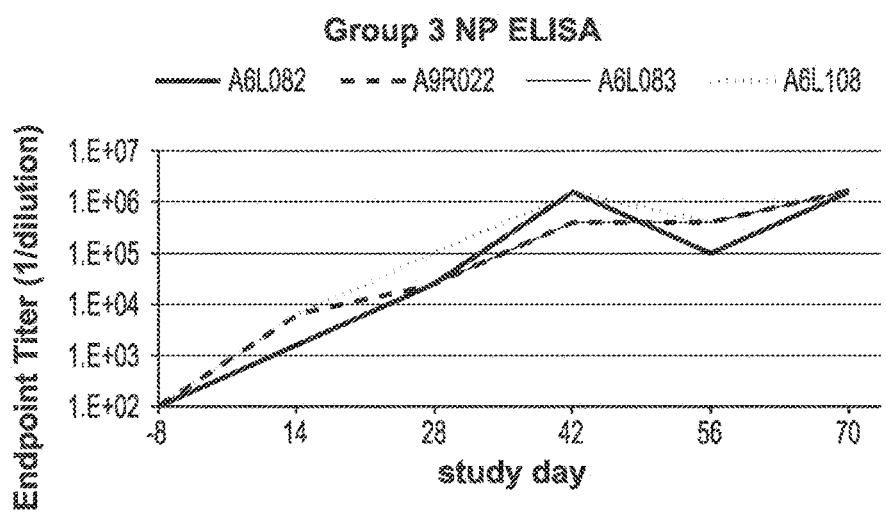

The NIHGen6HASS-foldon vaccine elicited a robust antibody response as measured by ELISA assay (plates coated with recombinantly-expressed NIHGen6HASS-foldon [HA stem] or NP proteins), and the data is depicted in FIG. 16. FIG. 16A shows titers to HA stem, over time, for four rhesus macaques previously vaccinated with FLUZONE® and boosted a single time with NIHGen6HASS-foldon mRNA vaccine. FIG. 16B depicts titers to HA stem, over time, from four rhesus macaques vaccinated at days 0, 28 and 56 with the same NIHGen6HASS-foldon RNA vaccine. The NIHGen6HASS-foldon RNA vaccine was able to boost anti-HA stem antibody binding titers in animal previously vaccinated with inactivated influenza vaccine as well as elicited a robust response in naïve animals. In both groups, HA stem titers remained elevated over baseline to at least study day 168. FIG. 16C illustrates antibody titers to NP, over time, for four rhesus macaques vaccinated at days 0, 28 and 56 with the NP mRNA vaccine and shows that the vaccine elicited a robust antibody response to NP.

Figure 17A:
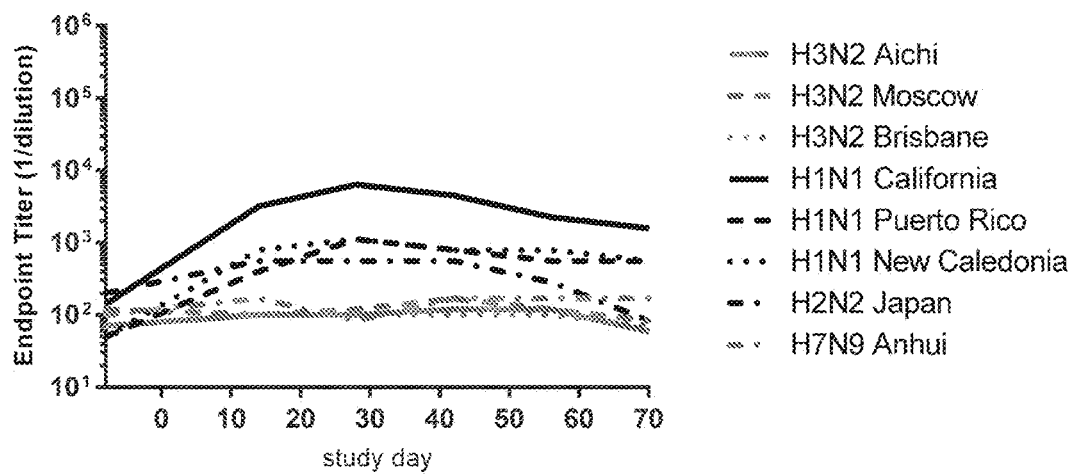
FIGS. 17A-17B show the results of ELISAs examining the presence of antibody capable of binding to recombinant hemagglutinin (rHA) from a wide variety of influenza strains.
Figure 17B:
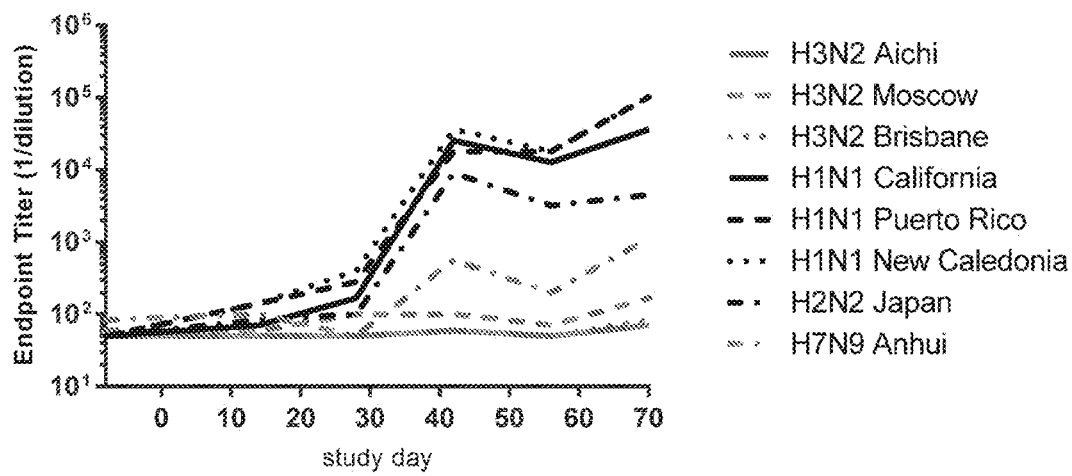

To test the Group 1 and 2 sera for the presence of antibody capable of binding to hemagglutinin (HA) from a wide variety of influenza strains, ELISA plates were coated with recombinant HAs from a diverse set of influenza strains as described above. EC10 titers were calculated as the reciprocal of the serum dilution that reached 10% of the maximal signal. For animals in Group 1 (FIG. 17A), a single dose of NIHGen6HASS-foldon vaccine boosted titers to H1 HAs ~40-60 fold, and titers peaked approximately 28 days post-vaccination. Titers decreased from days 28-70, but day 70 titers were still ~10-30-fold above the titers measured prior to vaccination. The NIHGen6HASS-foldon mRNA vaccine did not boost titers to HAs from H3 or H7 influenza strains. For animals in Group 2 (FIG. 17B), antibody titers to H1 and H2 HAs rose after each dose of NIHGen6HASS-foldon mRNA vaccine, and titers appeared to rise most dramatically after dose 2.

Figure 18:
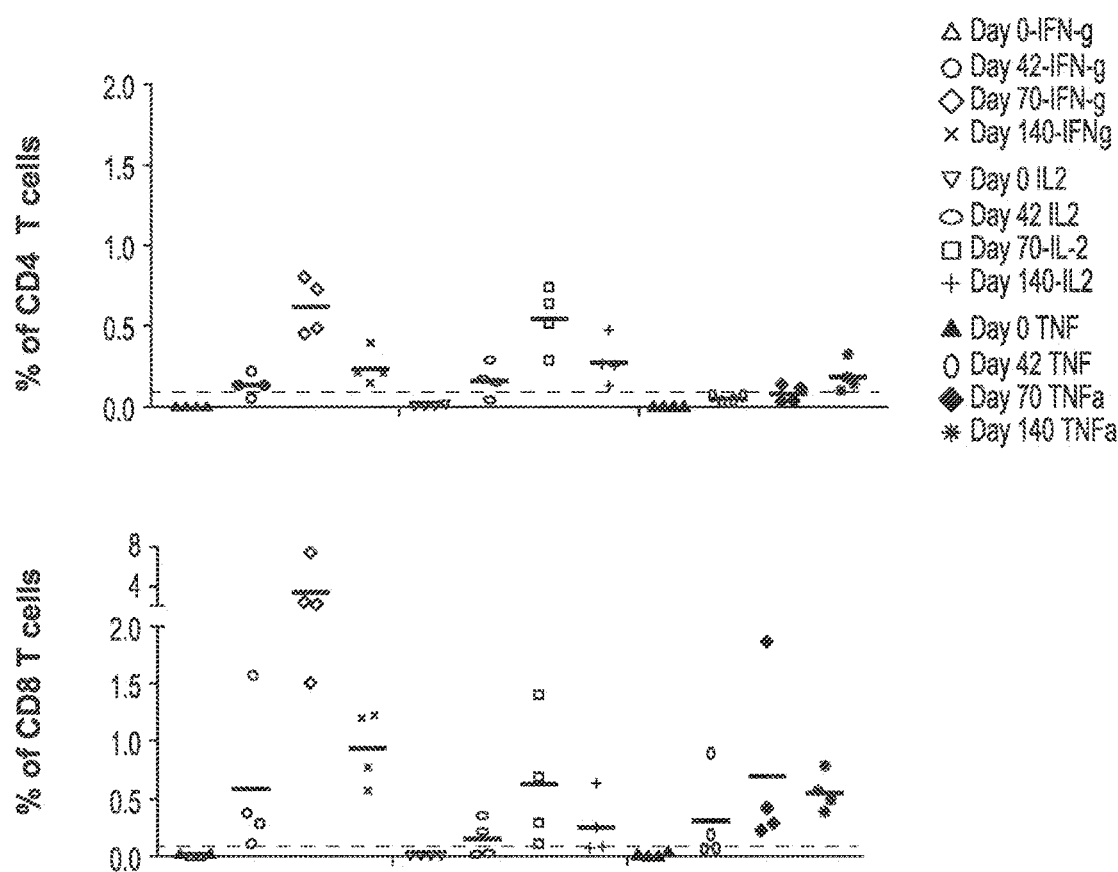
FIG. 18 is a representation of cell-mediated immune responses following mRNA vaccination. Peripheral blood mononuclear cells were harvested from vaccinated macaques and stimulated with a pool of overlapping NP peptides. The % of CD4 or CD8 T cells secreting one of the three cytokines (IFN-γ, IL-2, or TNF-α) is plotted.

In addition to robust antibody responses, the NP mRNA vaccine also elicited cell-mediated immunity in rhesus. On study day 0, 42, 70 and 140, PBMCs were collected from Group 3 NP mRNA vaccinated rhesus macaques. Lymphocytes were stimulated with a pool of NP peptides, and IFN-γ, IL-2 or TNF-α production were measured by intracellular staining and flow cytometry. FIG. 18 is a representation of responses following NP peptide pool stimulation. Following vaccination with NP mRNA, antigen-specific CD4 and CD8 T cells were found in the peripheral blood, and these cells were maintained above baseline to at least study day 140.

Example 15: H7N9 Immunogenicity Studies

The instant study was designed to test H7N9 immunogenicity. Intramuscular immunizations of 25 µM were administered on days 1 and 22 to 40 animals, and blood was collected on days 1, 8, 22, and 43. Hemagglutination inhibition (HAI) and microneutralization tests were conducted using the blood samples.

Figure 19:
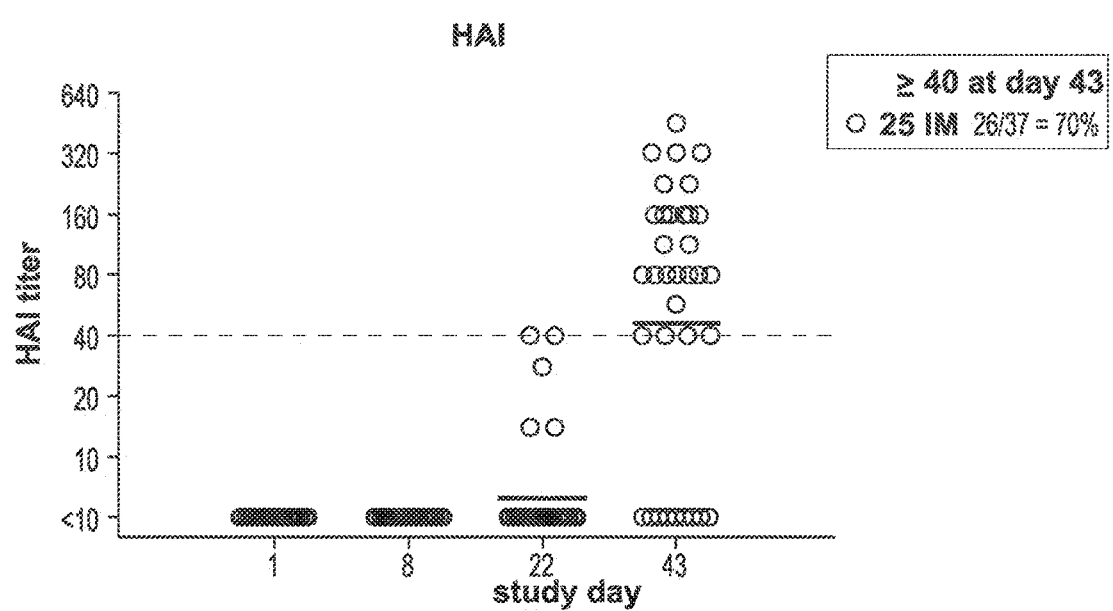
FIG. 19 shows the results of hemagglutination inhibition (HAI) tests. Placebo subjects (targeted to be 25% of each cohort) are included. The data is shown per protocol, and excludes those that did not receive the day 22 injection.
Figure 20:
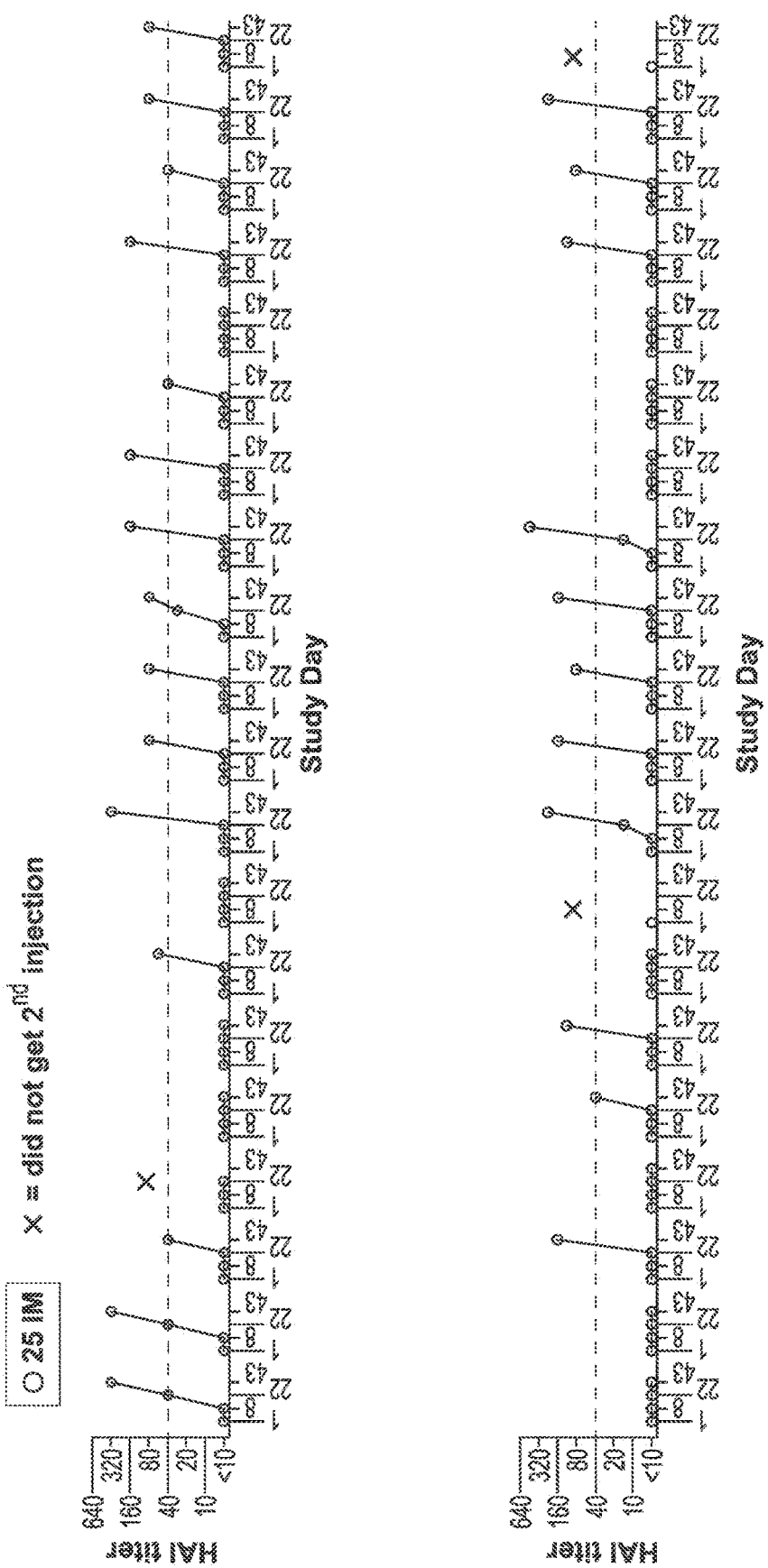
FIG. 20 shows the HAI test kinetics per subject, including the placebo subjects (targeted to be 25% of each cohort).

The HAI test showed a geometric mean titer (GMT) of 45 for all of the animals, including the placebo group. The GMT of the responders only was 116 (FIG. 19). The HAI kinetics for each individual subject are given in FIG. 20.

Figure 21:
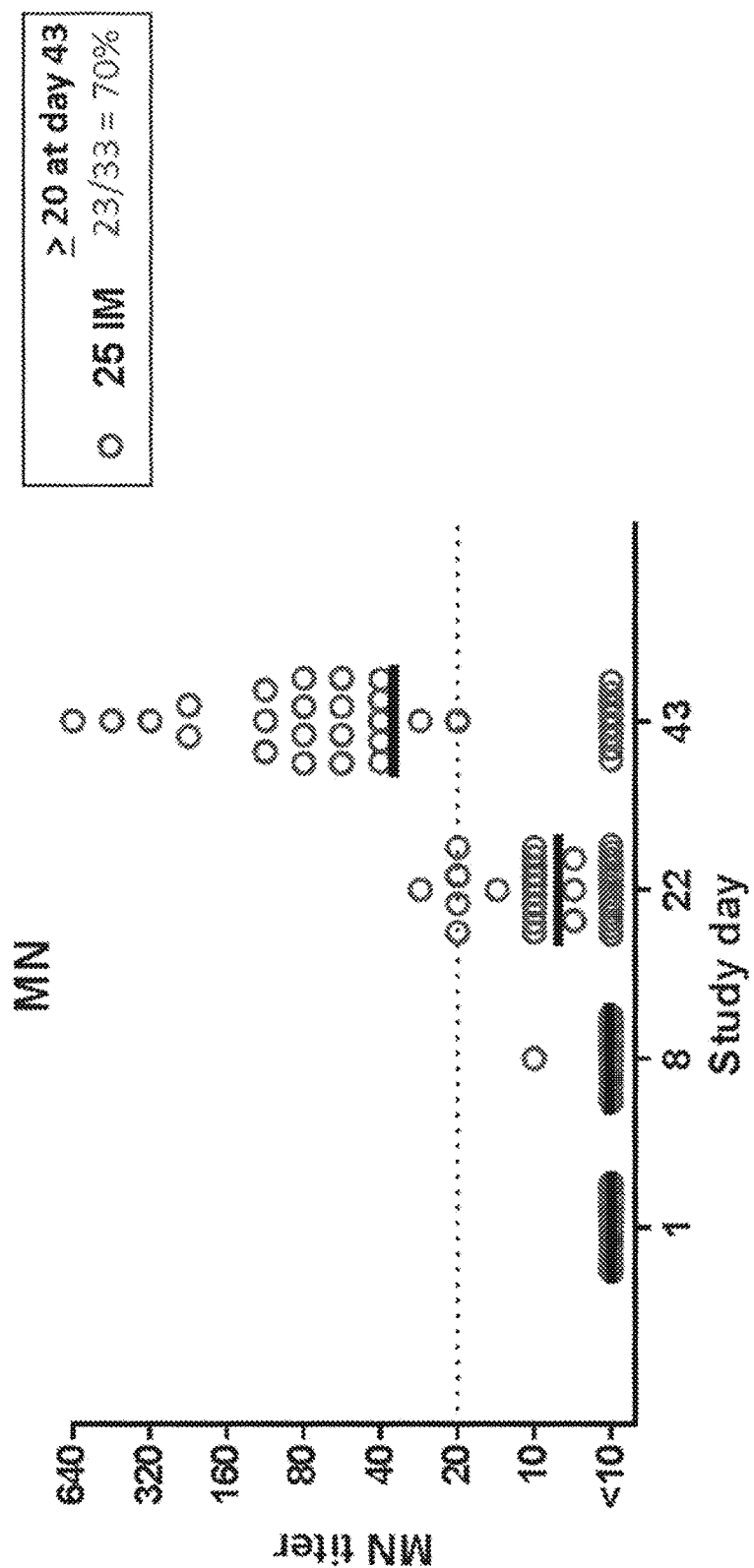
FIG. 21 shows the results of microneutralization (MN) tests, including placebo subjects (targeted to be 25% of each cohort). The data shown is per protocol, and excludes those that did not receive a day 22 injection.
Figure 22:
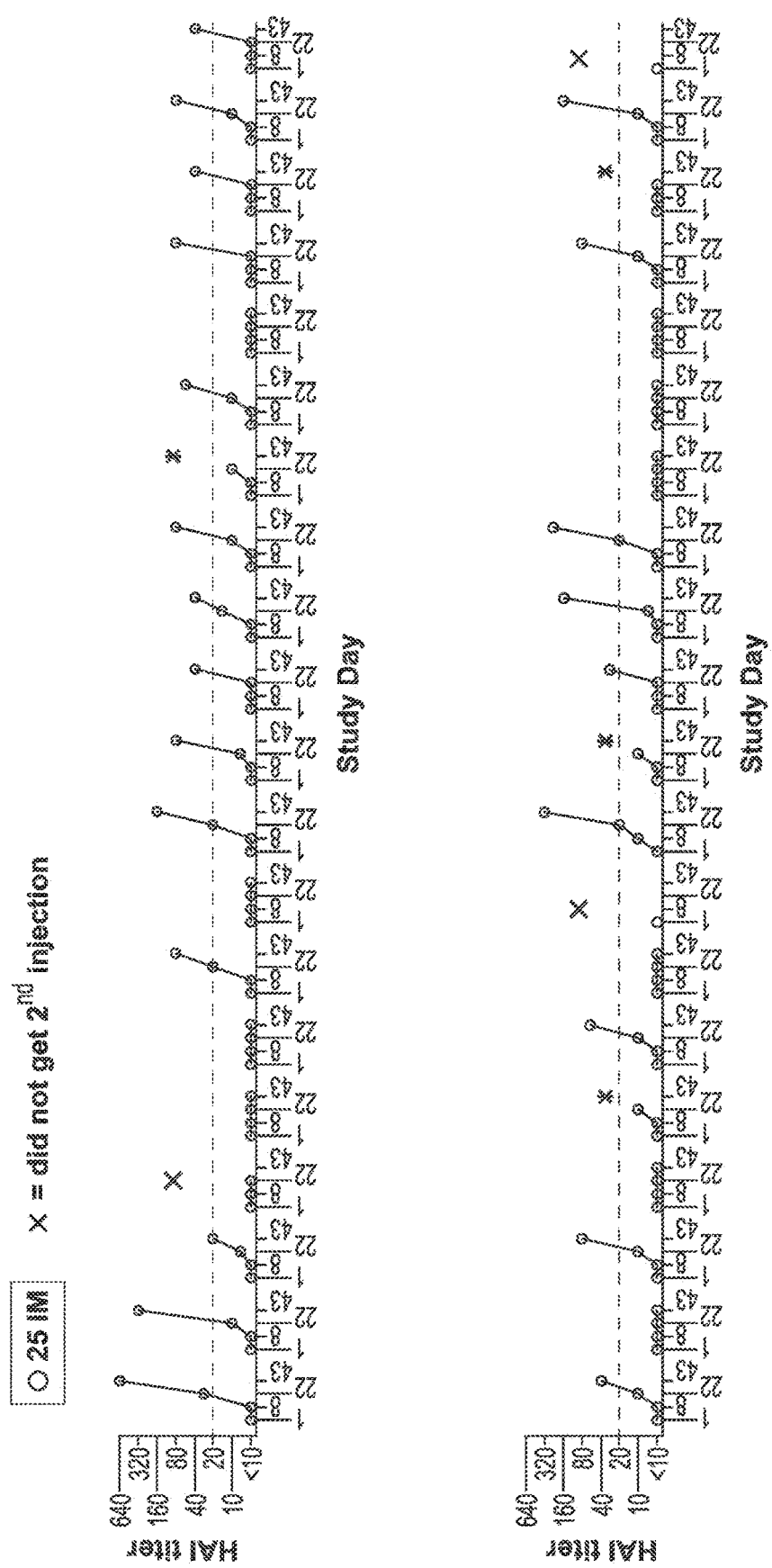
FIG. 22 shows the MN test kinetics per subject, including the placebo subjects (targeted to be 25% of each cohort).

The microneutralization (MN) test showed a geometric mean titer (GMT) of 36 for all of the animals, including the placebo group. The GMT of the responders only was 84 (FIG. 21). The MN test kinetics for each subject are given in FIG. 22.

Figure 23:
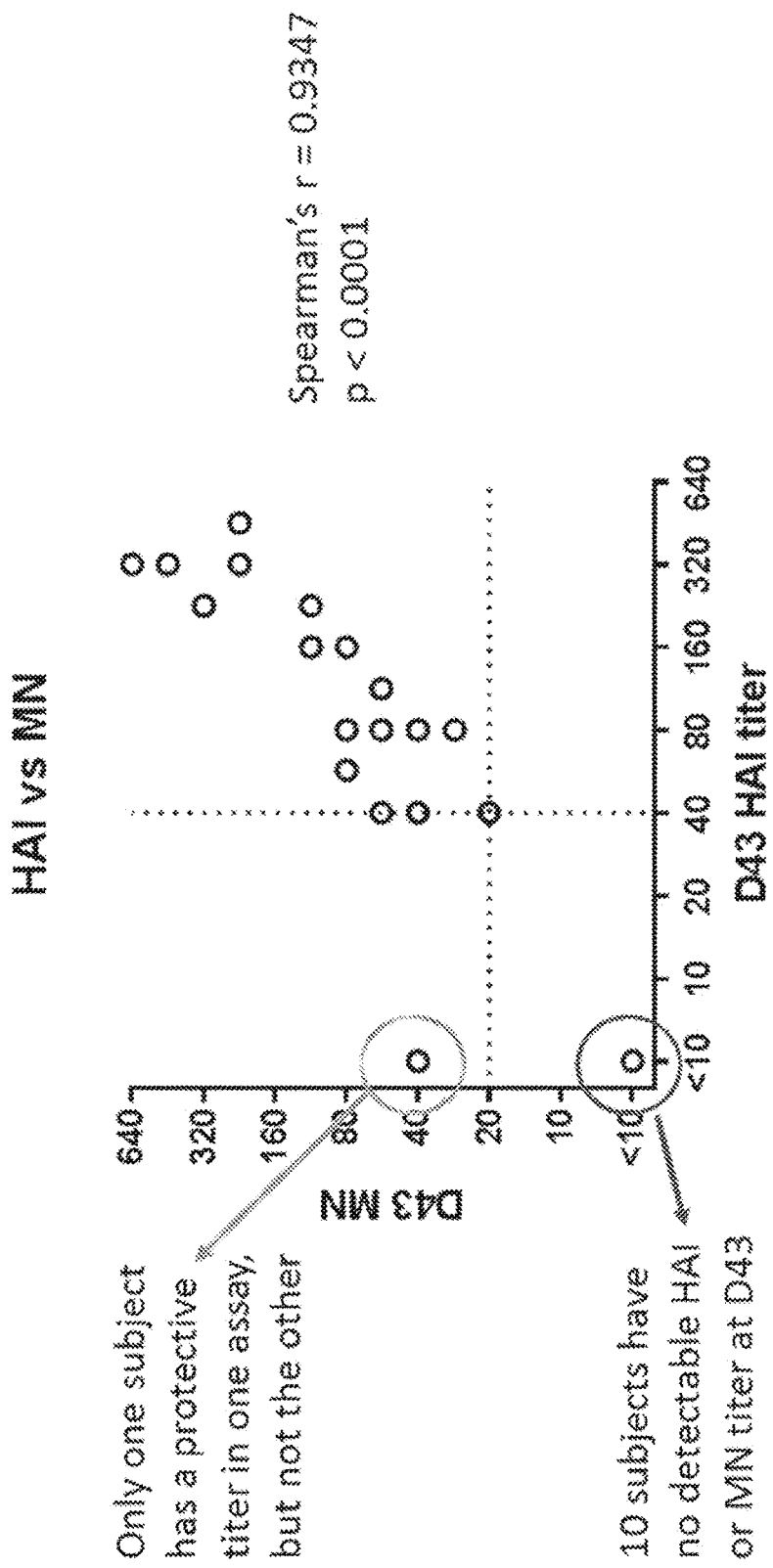
FIG. 23 is a graph depicting the very strong correlation between HAI and MN. The data includes placebo subjects (targeted to be 25% of each cohort).

HAI and MN showed a very strong correlation (FIG. 23). Only one subject had a protective titer in one assay, but not in the other. Also, 10 subjects had no detectable HAI or MN titer at Day 43.

Example 16: Mouse Immunogenicity Studies

This study was designed to test the immunogenicity and efficacy in mice of candidate influenza virus vaccines. Animals tested were 6-8 week old female BALB/c mice obtained from Charles River Laboratories. Test vaccines included the following mRNAs formulated in a cationic LNP: MRK_H1_cot_all, MRK_H3_cot_all, MRK_H3_con_all, MRK_H3_Consensus A and MRK_H3_Consensus B. Control animals were vaccinated with an mRNA encoding the HA from H1N1 A/Puerto Rico/8/1934 (FLHA_PR8, positive control for PR8 infection), vaccinated with empty LNP, infected with a nonlethal dose of mouse-adapted H3 A/Hong Kong/1/1968, or were not vaccinated (naïve).

At week 0 and week 3, animals were immunized intramuscularly (IM) with a total volume of 100 mL of each test vaccine, which was administered in a 50 mL immunization to each quadricep. Candidate influenza virus vaccines evaluated in this study were described above and outlined in the table below. Sera were collected from all animals two weeks after the second dose. At week 6, all animals were challenged intranasally while sedated with a mixture of Ketamine and Xylazine with a lethal dose of mouse-adapted influenza virus strain H1N1 A/Puerto Rico/8/1934 (PR8) or H3 A/Hong Kong/1/1968 (HK68). Mortality was recorded and group mouse weight was assessed daily for 20 days post-infection.

TABLE A

| Group # | Antigen | Antigen dose | Formulation | Volume, Route |
|---|---|---|---|---|
| 1 | FLHA_PR8 RNA (SEQ ID NO: 541) | 5 ug | LNP | 100 ul, i.m. |
| 2 | MRK_H1_cot_all RNA (SEQ ID NO: 530) | 10 ug | LNP | 100 ul, i.m. |
| 3 | MRK_H3_cot_all RNA (SEQ ID NO: 534) | 10 ug | LNP | 100 ul, i.m. |
| 4 | MRK_H3_con_all RNA (SEQ ID NO: 533) | 10 ug | LNP | 100 ul, i.m. |
| 5 | MRK_H3_Consensus A RNA (SEQ ID NO: 531) | 10 ug | LNP | 100 ul, i.m. |
| 6 | MRK_H3_Consensus B RNA (SEQ ID NO: 532) | 10 ug | LNP | 100 ul, i.m. |
| 7 | Empty LNP | 0 ug | LNP | 100 ul, i.m. |
| 8 | Mouse-adapted H3 A/Hong Kong/1/1968 virus | 0.1 LD90 | None | 20 ul, i.n. |
| 9 | Naïve | 0 ug | None | None |

To assess the breadth of the serum activity elicited by the antigens, hemagglutination inhibition assays (HAI) were performed using a panel of H1N1 and H3N2 influenza viruses (Tables B and C. Briefly, serum samples were treated with receptor destroying enzyme (RDE) for 18-20 hrs at 37° C. before inactivation at 56° C. for 35-45 min. RDE-treated sera was then serially diluted in a 96 well plate and mixed with 4 hemagglutinating units of virus. An equal volume of 0.5% turkey red blood cells was added to each well, and plates were incubated at room temperature for 30 min. The highest dilution with no visible agglutination was assigned as the serum titer. While the MRK-H1_cot_all mRNA vaccine elicited titers to only two viruses in the H1 HAI panel (Table B), the MRK_H3_cot_all, MRK_H3-con_all, MRK_H3_Consensus A and MRK_H3-Consensus B mRNAs induced high HAI titers to multiple H3 strains isolated between 1997 and 2014 (Table C).

Figure 24A:
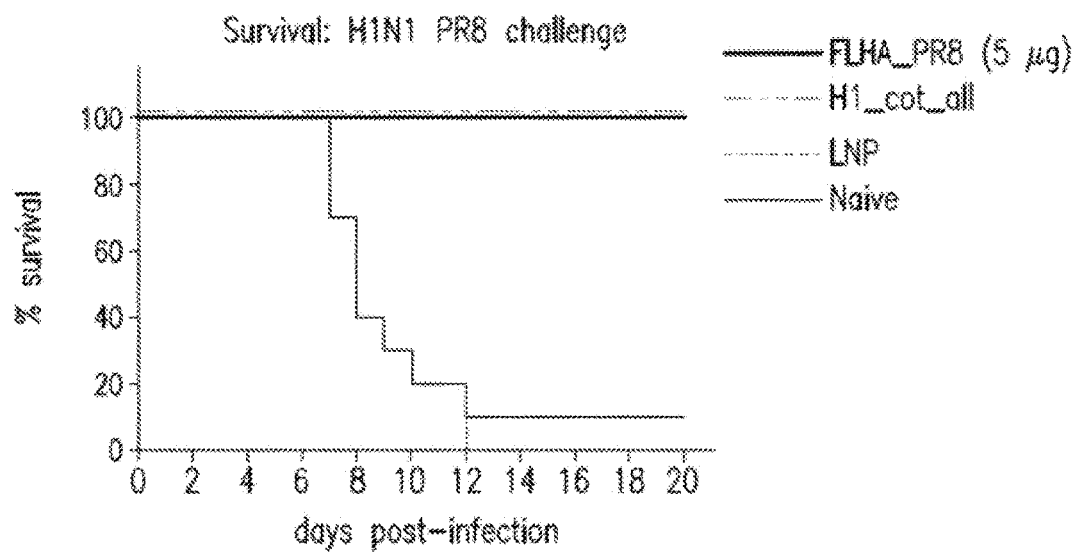
FIG. 24A shows murine survival following challenge with a lethal dose of mouse-adapted influenza virus strain H1N1 A/Puerto Rico/8/1934 (PR8) or H3 A/Hong Kong/1/1968 (HK68).
Figure 24B:
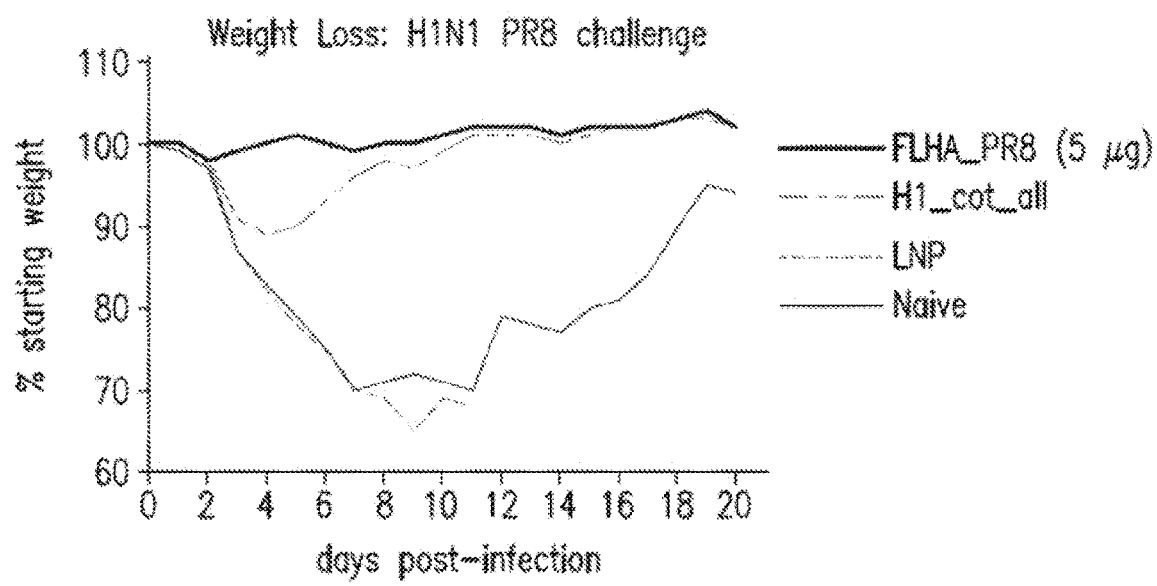
FIG. 24B shows murine weight loss following challenge with a lethal dose of mouse-adapted influenza virus strain H1N1 A/Puerto Rico/8/1934 (PR8) or H3 A/Hong Kong/1/1968 (HK68).
Figure 24C:
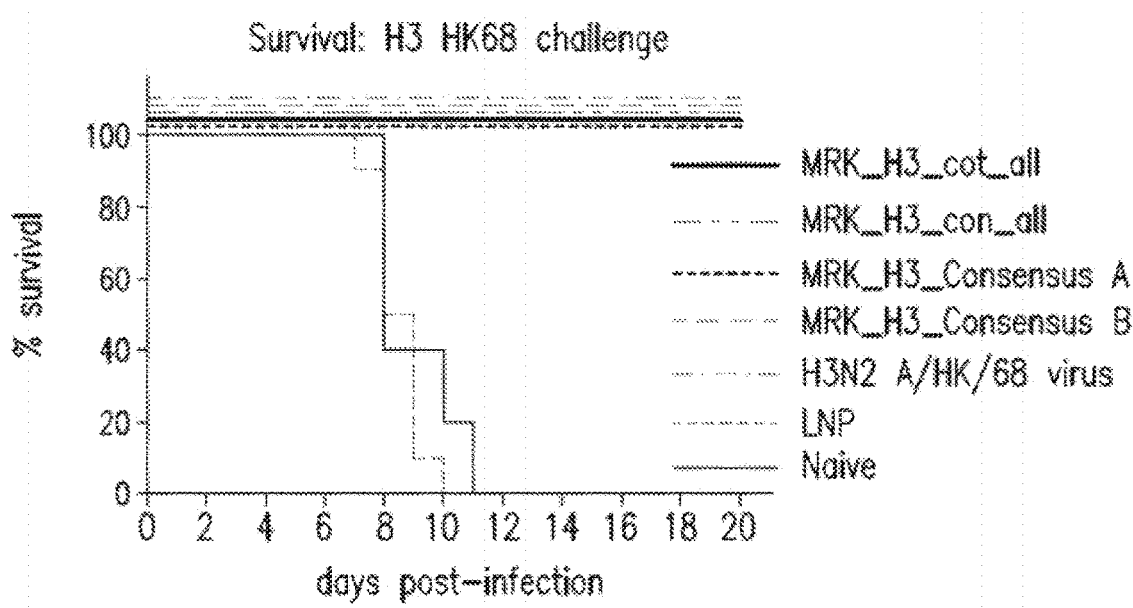
FIG. 24C shows murine survival following challenge with a lethal dose of HK68 virus.
Figure 24D:
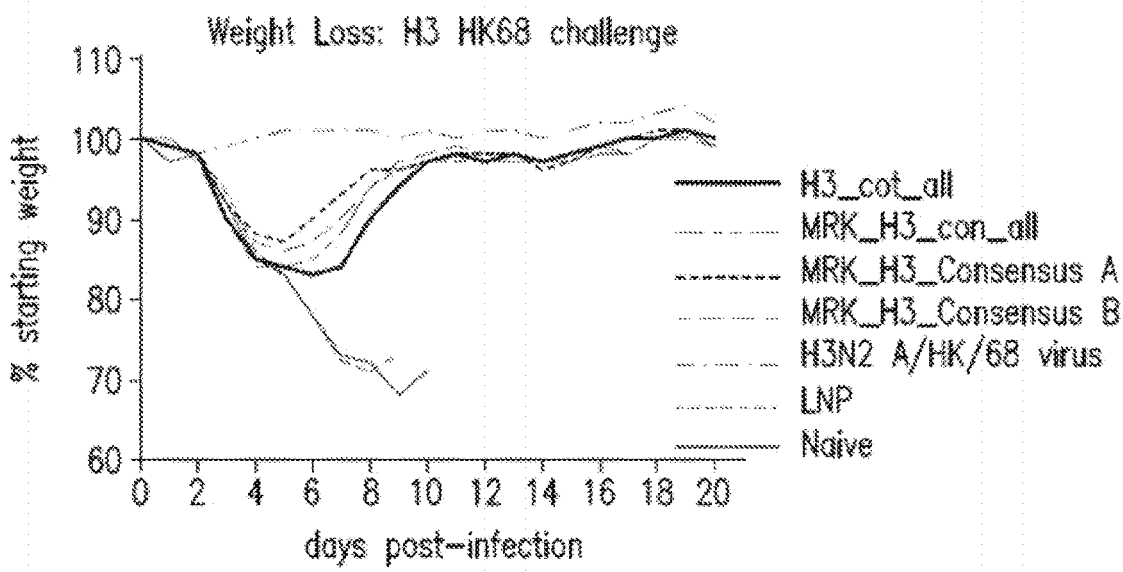
FIG. 24D shows murine weight loss following challenge with a lethal dose of HK68 virus. The percentage of group survival and weight loss as compared to baseline was calculated and plotted over time in days.

Although mice immunized with MRK_H1_cot_all mRNA did not have detectable HAI titers to the PR8 virus, they were partially protected from lethal challenge with PR8 virus. In contrast to naïve or LNP vaccinated mice, all MRK_H1_cot_all mRNA immunized mice survived challenge (FIG. 24A), though they lost, on average, approximately 10% of their body weight post-infection (FIG. 24). Similarly, mice vaccinated with any of the H3 COT or consensus mRNAs tested survived challenge with a lethal dose of HK68 virus (FIG. 24C) but lost between 10 and 15% or their body weight post-infection (FIG. 24D).

TABLE B

| Vaccine | A/Puerto Rico/8/1934 | A/Fort/Monmouth/1/1947 | A/New Jersey/10/1976 | A/Brazil/11/1978 | A/Singapore/6/1986 | A/Texas/36/1991 |
|---|---|---|---|---|---|---|
| MRK H1 cot all | <10 | <10 | 2,560 | <10 | <10 | <10 |
| Naive | <10 | <10 | <10 | <10 | <10 | <10 |

| Vaccine | A/Beijing/262/1995 | A/New Caledonia/20/1999 | A/Solomon Islands/3/2006 | A/Brisbane/59/2007 | A/California/07/2009 | |
|---|---|---|---|---|---|---|
| MRK H1 cot all | <10 | <10 | <10 | <10 | 10,240 | — |
| Naive | <10 | <10 | <10 | <10 | <10 | — |

TABLE C

| Vaccine | A/HongKong/ 1/1968 | A/Philippines/ 1982 | A/Sydney/ 5/1997 | A/Texas/ 50/2012 | A/Switzerland/ 9715293/2013 | A/HongKong/ 4801/2014 |
|---|---|---|---|---|---|---|
| H3_cot_all | <10 | <10 | <10 | 40,960 | 20,480 | 10,240 |
| MRK_H3_con_all | <10 | <10 | <10 | 40,960 | 10,240 | 10,240 |
| MRK_H3_ConA | <10 | <10 | 10,240 | 640 | 320 | 20 |
| MRK_H3_ConB | <10 | <10 | <10 | 40,960 | 10,240 | 10,240 |
| Naive | <10 | <10 | <10 | <10 | <10 | <10 |

TABLE 7

Influenza H1N1 Antigens

| Strain/Protein | Length | GenBank/GI Accession No. |
|---|---|---|
| Influenza A virus (A/Bayern/7/95(H1N1)) NA gene for neuraminidase, genomic RNA | 1,459 bp linear mRNA | AJ518104.1 GI: 31096418 |
| Influenza A virus (A/Brazil/11/1978(X-71)(H1N1)) mRNA for hemagglutinin HA1, escape variant 1 | 1,072 bp linear mRNA | X86654.1 GI: 995549 |
| Influenza A virus (A/Brazil/11/1978(X-71)(H1N1)) mRNA for hemagglutinin HA1, escape variant 2 | 1,072 bp linear mRNA | X86655.1 GI: 995550 |
| Influenza A virus (A/Brazil/11/1978(X-71)(H1N1)) mRNA for hemagglutinin HA1, escape variant 3 | 1,072 bp linear mRNA | X86656.1 GI: 995551 |
| Influenza A virus (A/Brazil/11/1978(X-71)(H1N1)) mRNA for hemagglutinin HA1, escape variant 4 | 1,072 bp linear mRNA | X86657.1 GI: 995552 |
| Influenza A virus (A/Brevig_Mission/1/18(H1N1)) hemagglutinin (HA) mRNA, partial cds | 1,220 bp linear mRNA | AF116575.1 GI: 4325017 |
| Influenza A virus (A/Brevig_Mission/1/18(H1N1)) neuraminidase (NA) gene, complete cds | 1,410 bp linear mRNA | AF250356.2 GI: 13260556 |
| Influenza A virus (A/Brevig Mission/1/1918(H1N1)) nucleoprotein (np) mRNA, complete cds | 1,497 bp linear mRNA | AY744935.1 GI: 55273940 |
| Influenza A virus (A/Brevig Mission/1/1918(H1N1)) polymerase PB2 (PB2) mRNA, complete cds | 2,280 bp linear mRNA | DQ208309.1 GI: 76786704 |
| Influenza A virus (A/Brevig Mission/1/1918(H1N1)) polymerase PB1 (PB1) mRNA, complete cds | 2,274 bp linear mRNA | DQ208310.1 GI: 76786706 |
| Influenza A virus (A/Brevig Mission/1/1918(H1N1)) polymerase PA (PA) mRNA, complete cds | 2,151 bp linear mRNA | DQ208311.1 GI: 76786708 |
| Influenza A virus (A/camel/Mongolia/1982(H1N1)) hemagglutinin mRNA, partial cds | 366 bp linear mRNA | M73975.1 GI: 324242 |
| Influenza A virus (A/camel/Mongolia/1982(H1N1)) matrix protein mRNA, partial cds | 460 bp linear mRNA | M73978.1 GI: 324402 |
| Influenza A virus (A/camel/Mongolia/1982(H1N1)) neuraminidase (NA) mRNA, partial cds | 310 bp linear mRNA | M73976.1 GI: 324579 |
| Influenza A Virus A/camel/Mongolia/82 NS1 protein mRNA, partial cds | 273 bp linear mRNA | M73977.1 GI: 324768 |
| Influenza A virus (A/camel/Mongolia/1982(H1N1)) PA polymerase mRNA, partial cds | 227 bp linear mRNA | M73974.1 GI: 324931 |
| Influenza A virus (A/camel/Mongolia/1982(H1N1)) PB1 protein mRNA, partial cds | 531 bp linear mRNA | M73973.1 GI: 324971 |
| Influenza A Virus (A/camel/Mongolia/82(H1N1)) polymerase 2 (P2) mRNA, partial cds | 379 bp linear mRNA | M73972.1 GI: 324993 |
| Influenza A virus (A/chicken/Hong Kong/14/1976(H1N1)) hemagglutinin precursor (HA) mRNA, partial cds | 1,169 bp linear mRNA | U46782.1 GI: 1912328 |
| Influenza A virus (A/Chonnam/07/2002(H1N1)) neuraminidase (NA) mRNA, complete cds | 1,452 bp linear mRNA | AY297141.1 GI: 31871990 |
| Influenza A virus (A/Chonnam/07/2002(H1N1)) hemagglutinin (HA) mRNA, partial cds | 1,137 bp linear mRNA | AY297154.1 GI: 32140347 |
| Influenza A virus (A/Chonnam/18/2002(H1N1)) neuraminidase (NA) mRNA, complete cds | 1,458 bp linear mRNA | AY297143.1 GI: 31871994 |

TABLE 7-continued

Influenza H1N1 Antigens

| Strain/Protein | Length | GenBank/GI Accession No. |
|---|---|---|
| Influenza A virus (A/Chonnam/18/2002(H1N1)) hemagglutinin (HA) mRNA, partial cds | 1,176 bp linear mRNA | AY297156.1 GI: 32140355 |
| Influenza A virus (A/Chonnam/19/2002(H1N1)) neuraminidase (NA) mRNA, complete cds | 1,458 bp linear mRNA | AY310410.1 GI: 31872389 |
| Influenza A virus (A/Chonnam/19/2002(H1N1)) hemagglutinin (HA) mRNA, partial cds | 1,167 bp linear mRNA | AY299502.1 GI: 32140392 |
| Influenza A virus (A/Chonnam/51/2002(H1N1)) neuraminidase (NA) mRNA, complete cds | 1,443 bp linear mRNA | AY310412.1 GI: 31873090 |
| Influenza A virus (A/Chonnam/51/2002(H1N1)) hemagglutinin (HA) mRNA, partial cds | 1,161 bp linear mRNA | AY299498.1 GI: 32140384 |
| Influenza A virus (A/Chungbuk/50/2002(H1N1)) neuraminidase (NA) mRNA, partial cds | 1,425 bp linear mRNA | AY297150.1 GI: 31872010 |
| Influenza A virus (A/Chungbuk/50/2002(H1N1)) hemagglutinin (HA) mRNA, partial cds | 1,161 bp linear mRNA | AY299506.1 GI: 32140400 |
| Influenza A virus (A/Denmark/40/2000(H1N1)) NA gene for neuraminidase, genomic RNA | 1,458 bp linear mRNA | AJ518095.1 GI: 31096400 |
| Influenza A virus (A/Denver/1/57(H1N1)) neuraminidase mRNA, partial cds | 379 bp linear mRNA | AF305216.1 GI: 10732818 |
| Influenza A virus (A/Denver/1/57(H1N1)) matrix protein gene, partial cds | 442 bp linear mRNA | AF305217.1 GI: 10732820 |
| Influenza A virus (A/Denver/1/57(H1N1)) hemagglutinin gene, partial cds | 215 bp linear mRNA | AF305218.1 GI: 10732822 |
| Influenza A virus (A/duck/Australia/749/80(H1N1)) hemagglutinin precursor (HA) mRNA, partial cds | 981 bp linear mRNA | U47309.1 GI: 1912348 |
| Influenza A virus (A/duck/Australia/749/80(H1N1)) segment 4 hemagglutinin precursor (HA) mRNA, complete cds | 1,777 bp linear mRNA | AF091312.1 GI: 4585166 |
| Influenza A virus (A/duck/Bavaria/1/77 (H1N1)) segment 4 hemagglutinin precursor (HA) mRNA, complete cds | 1,777 bp linear mRNA | AF091313.1 GI: 4585168 |
| Influenza A virus (A/duck/Bavaria/2/77(H1N1)) hemagglutinin precursor (HA) mRNA, partial cds | 981 bp linear mRNA | U47308.1 GI: 1912346 |
| Influenza A virus (A/duck/Eastern China/103/2003(H1N1)) segment 6 neuraminidase (NA) mRNA, complete cds | 1,458 bp linear mRNA | EU429749.1 GI: 167859463 |
| Influenza A virus (A/duck/Eastern China/152/2003(H1N1)) segment 6 neuraminidase (NA) mRNA, complete cds | 1,461 bp linear mRNA | EU429751.1 GI: 167859467 |
| Influenza A virus (A/Duck/Ohio/118C/93 (H1N1)) neuraminidase (NA) gene, complete cds | 1,410 bp linear mRNA | AF250361.2 GI: 13260576 |
| Influenza A virus (A/Duck/Ohio/175/86 (H1N1)) neuraminidase (NA) gene, complete cds | 1,410 bp linear mRNA | AF250358.2 GI: 13260565 |
| Influenza A virus (A/Duck/Ohio/194/86 (H1N1)) neuraminidase (NA) gene, complete cds | 1,410 bp linear mRNA | AF250360.2 GI: 13260573 |
| Influenza A virus (A/Duck/Ohio/30/86 (H1N1)) neuraminidase (NA) gene, complete cds | 1,410 bp linear mRNA | AF250359.2 GI: 13260570 |
| Influenza A virus strain A/Fiji/15899/83(H1N1) mRNA for neuraminidase | 1,460 bp linear mRNA | AJ006954.1 GI: 4210707 |
| Influenza A Virus (A/Fiji/15899/83(H1N1)) mRNA for PB2 protein | 2,341 bp linear mRNA | AJ564805.1 GI: 31442134 |
| Influenza A Virus (A/Fiji/15899/83(H1N1)) partial mRNA for PB1 protein | 2,113 bp linear mRNA | AJ564807.1 GI: 31442138 |
| Influenza A virus (A/FM/1/47 (H1N1)) neuraminidase (NA) gene, complete cds | 1,395 bp linear mRNA | AF250357.2 GI: 13260561 |
| Influenza A virus (A/goose/Hong Kong/8/1976(H1N1)) hemagglutinin precursor (HA) mRNA, partial cds | 1,091 bp linear mRNA | U46021.1 GI: 1912326 |
| Influenza A virus (A/goose/Hong Kong/8/1976(H1N1)) polymerase (PB1) mRNA, partial cds | 261 bp linear mRNA | U48284.1 GI: 1912372 |
| Influenza A virus (A/goose/Hong Kong/8/1976(H1N1)) nucleoprotein (NP) mRNA, partial cds | 1,395 bp linear mRNA | U49093.1 GI: 1912384 |
| Influenza A virus (A/Guangzhou/1561/2006(H1N1)) segment 4 hemagglutinin (HA) mRNA, complete cds | 1,775 bp linear mRNA | EU382986.1 GI: 170762603 |
| Influenza A virus (A/Guangzhou/1561/2006(H1N1)) segment 6 neuraminidase (NA) mRNA, complete cds | 1,462 bp linear mRNA | EU382993.1 GI: 170762617 |
| Influenza A virus (A/Guangzhou/1684/2006(H1N1)) segment 4 hemagglutinin (HA) mRNA, complete cds | 1,775 bp linear mRNA | EU382987.1 GI: 170762605 |

TABLE 7-continued

| Influenza H1N1 Antigens | | |
|---|---|---|
| Strain/Protein | Length | GenBank/GI Accession No. |
| Influenza A virus (A/Guangzhou/1684/2006(H1N1)) segment 6 neuraminidase (NA) mRNA, complete cds | 1,462 bp linear mRNA | EU382994.1 GI: 170762619 |
| Influenza A virus (A/Guangzhou/483/2006(H1N1)) segment 4 hemagglutinin (HA) mRNA, complete cds | 1,775 bp linear mRNA | EU382981.1 GI: 170762593 |
| Influenza A virus (A/Guangzhou/483/2006(H1N1)) segment 6 neuraminidase (NA) mRNA, complete cds | 1,462 bp linear mRNA | EU382988.1 GI: 170762607 |
| Influenza A virus (A/Guangzhou/506/2006(H1N1)) segment 4 hemagglutinin (HA) mRNA, complete cds | 1,775 bp linear mRNA | EU382982.1 GI: 170762595 |
| Influenza A virus (A/Guangzhou/506/2006(H1N1)) segment 6 neuraminidase (NA) mRNA, complete cds | 1,461 bp linear mRNA | EU382989.1 GI: 170762609 |
| Influenza A virus (A/Guangzhou/555/2006(H1N1)) segment 4 hemagglutinin (HA) mRNA, complete cds | 1,775 bp linear mRNA | EU382983.1 GI: 170762597 |
| Influenza A virus (A/Guangzhou/555/2006(H1N1)) segment 6 neuraminidase (NA) mRNA, complete cds | 1,462 bp linear mRNA | EU382990.1 GI: 170762611 |
| Influenza A virus (A/Guangzhou/657/2006(H1N1)) segment 4 hemagglutinin (HA) mRNA, complete cds | 1,775 bp linear mRNA | EU382984.1 GI: 170762599 |
| Influenza A virus (A/Guangzhou/657/2006(H1N1)) segment 6 neuraminidase (NA) mRNA, complete cds | 1,462 bp linear mRNA | EU382991.1 GI: 170762613 |
| Influenza A virus (A/Guangzhou/665/2006(H1N1)) segment 4 hemagglutinin (HA) mRNA, complete cds | 1,775 bp linear mRNA | EU382985.1 GI: 170762601 |
| Influenza A virus (A/Guangzhou/665/2006(H1N1)) segment 6 neuraminidase (NA) mRNA, complete cds | 1,462 bp linear mRNA | EU382992.1 GI: 170762615 |
| Influenza A virus (A/Gwangju/55/2002(H1N1)) neuraminidase (NA) mRNA, complete cds | 1,431 bp linear mRNA | AY297151.1 GI: 31872012 |
| Influenza A virus (A/Gwangju/55/2002(H1N1)) hemagglutinin (HA) mRNA, partial cds | 1,179 bp linear mRNA | AY299507.1 GI: 32140402 |
| Influenza A virus (A/Gwangju/57/2002(H1N1)) neuraminidase (NA) mRNA, complete cds | 1,446 bp linear mRNA | AY297152.1 GI: 31872014 |
| Influenza A virus (A/Gwangju/57/2002(H1N1)) hemagglutinin (HA) mRNA, partial cds | 1,167 bp linear mRNA | AY299508.1 GI: 32140404 |
| Influenza A virus (A/Gwangju/58/2002(H1N1)) neuraminidase (NA) mRNA, complete cds | 1,434 bp linear mRNA | AY297153.1 GI: 31872016 |
| Influenza A virus (A/Gwangju/58/2002(H1N1)) hemagglutinin (HA) mRNA, partial cds | 1,176 bp linear mRNA | AY299509.1 GI: 32140406 |
| Influenza A virus (A/Gwangju/90/2002(H1N1)) neuraminidase (NA) mRNA, complete cds | 1,446 bp linear mRNA | AY297147.1 GI: 31872002 |
| Influenza A virus (A/Gwangju/90/2002(H1N1)) hemagglutinin (HA) mRNA, partial cds | 1,164 bp linear mRNA | AY299499.1 GI: 32140386 |
| Influenza A virus (A/Hong Kong/437/2002(H1N1)) partial NA gene for neuraminidase, genomic RNA | 1,403 bp linear mRNA | AJ518101.1 GI: 31096412 |
| Influenza A virus (A/Hong Kong/747/2001(H1N1)) partial NA gene for neuraminidase, genomic RNA | 1,352 bp linear mRNA | AJ518102.1 GI: 31096414 |
| Influenza A virus (A/London/1/1918(H1N1)) hemagglutinin (HA) mRNA, partial cds | 563 bp linear mRNA | AY184805.1 GI: 32395285 |
| Influenza A virus (A/London/1/1919(H1N1)) hemagglutinin (HA) mRNA, partial cds | 563 bp linear mRNA | AY184806.1 GI: 32395287 |
| Influenza A virus (A/Loygang/4/1957(H1N1)) nucleoprotein mRNA, complete cds | 1,565 bp linear mRNA | M76604.1 GI: 324255 |
| Influenza A virus (A/Lyon/651/2001(H1N1)) partial NA gene for neuraminidase, genomic RNA | 1,318 bp linear mRNA | AJ518103.1 GI: 31096416 |
| Influenza A virus (A/mallard/Alberta/119/98 (H1N1)) nonfunctional matrix protein mRNA, partial sequence | 947 bp linear mRNA | AY664487.1 GI: 51011891 |
| Influenza A virus (A/duck/Alberta/35/76(H1N1)) hemagglutinin precursor (HA) mRNA, partial cds | 981 bp linear mRNA | U47310.1 GI: 1912350 |
| Influenza A virus (A/duck/Alberta/35/76(H1N1)) segment 4 hemagglutinin precursor (HA) mRNA, complete cds | 1,777 bp linear mRNA | AF091309.1 GI: 4585160 |

TABLE 7-continued

| Influenza H1N1 Antigens | | |
|---|---|---|
| Strain/Protein | Length | GenBank/GI Accession No. |
| Influenza A virus (A/duck/Alberta/35/76(H1N1)) neuraminidase (NA) gene, complete cds | 1,410 bp linear mRNA | AF250362.2 GI: 13260579 |
| Influenza A virus (A/mallard/Tennessee/11464/85 (H1N1)) hemagglutinin precursor (HA) mRNA, partial cds | 981 bp linear mRNA | U47307.1 GI: 1912344 |
| Influenza A virus (A/mallard/Tennessee/11464/85 (H1N1)) segment 4 hemagglutinin precursor (HA) mRNA, complete cds | 1,777 bp linear mRNA | AF091311.1 GI: 4585164 |
| Influenza A virus (A/New Caledonia/20/1999(H1N1)) segment 7 matrix protein 2 (M2) mRNA, complete cds | 294 bp linear mRNA | HQ008884.1 GI: 302566794 |
| Influenza A virus (A/New Jersey/4/1976(H1N1)) nucleoprotein mRNA, complete cds | 1,565 bp linear mRNA | M76605.1 GI: 324581 |
| Influenza A virus (A/New Jersey/8/1976(H1N1)) nucleoprotein mRNA, complete cds | 1,565 bp linear mRNA | M76606.1 GI: 324583 |
| Influenza A virus (A/New_York/1/18(H1N1)) hemagglutinin (HA) mRNA, partial cds | 1,220 bp linear mRNA | AF116576.1 GI: 4325019 |
| Influenza A virus (A/Ohio/3523/1988(H1N1)) nucleoprotein mRNA, complete cds | 1,565 bp linear mRNA | M76602.1 GI: 324889 |
| Influenza A virus (A/Pusan/22/2002(H1N1)) neuraminidase (NA) mRNA, complete cds | 1,455 bp linear mRNA | AY310411.1 GI: 31872391 |
| Influenza A virus (A/Pusan/22/2002(H1N1)) hemagglutinin (HA) mRNA, partial cds | 1,149 bp linear mRNA | AY299503.1 GI: 32140394 |
| Influenza A virus (A/Pusan/23/2002(H1N1)) neuraminidase (NA) mRNA, complete cds | 1,440 bp linear mRNA | AY297144.1 GI: 31871996 |
| Influenza A virus (A/Pusan/23/2002(H1N1)) hemagglutinin (HA) mRNA, partial cds | 1,158 bp linear mRNA | AY297157.1 GI: 32140357 |
| Influenza A virus (A/Pusan/24/2002(H1N1)) neuraminidase (NA) mRNA, complete cds | 1,449 bp linear mRNA | AY297145.1 GI: 31871998 |
| Influenza A virus (A/Pusan/24/2002(H1N1)) hemagglutinin (HA) mRNA, partial cds | 1,128 bp linear mRNA | AY299494.1 GI: 32140376 |
| Influenza A virus (A/Pusan/44/2002(H1N1)) neuraminidase (NA) mRNA, complete cds | 1,431 bp linear mRNA | AY297148.1 GI: 31872004 |
| Influenza A virus (A/Pusan/44/2002(H1N1)) hemagglutinin (HA) mRNA, partial cds | 1,167 bp linear mRNA | AY299504.1 GI: 32140396 |
| Influenza A virus (A/Pusan/45/2002(H1N1)) neuraminidase (NA) mRNA, complete cds | 1,434 bp linear mRNA | AY297146.1 GI: 31872000 |
| Influenza A virus (A/Pusan/45/2002(H1N1)) hemagglutinin (HA) mRNA, partial cds | 1,167 bp linear mRNA | AY299496.1 GI: 32140380 |
| Influenza A virus (A/Pusan/46/2002(H1N1)) neuraminidase (NA) mRNA, complete cds | 1,422 bp linear mRNA | AY310408.1 GI: 31872385 |
| Influenza A virus (A/Pusan/46/2002(H1N1)) hemagglutinin (HA) mRNA, partial cds | 1,176 bp linear mRNA | AY299497.1 GI: 32140382 |
| Influenza A virus (A/Pusan/47/2002(H1N1)) neuraminidase (NA) mRNA, complete cds | 1,437 bp linear mRNA | AY297149.1 GI: 31872008 |
| Influenza A virus (A/Pusan/47/2002(H1N1)) hemagglutinin (HA) mRNA, partial cds | 1,170 bp linear mRNA | AY299505.1 GI: 32140398 |
| Influenza A virus (A/Saudi Arabia/7971/2000(H1N1)) partial NS1 gene for non structural protein 1 and partial NS2 gene for non structural protein 2, genomic RNA | 789 bp linear mRNA | AJ519463.1 GI: 31096450 |
| Influenza A virus (A/Seoul/11/2002(H1N1)) neuraminidase (NA) mRNA, complete cds | 1,452 bp linear mRNA | AY297142.1 GI: 31871992 |
| Influenza A virus (A/Seoul/11/2002(H1N1)) hemagglutinin (HA) mRNA, partial cds | 1,176 bp linear mRNA | AY297155.1 GI: 32140349 |
| Influenza A virus (A/Seoul/13/2002(H1N1)) neuraminidase (NA) mRNA, complete cds | 1,452 bp linear mRNA | AY310409.1 GI: 31872387 |
| Influenza A virus (A/Seoul/13/2002(H1N1)) hemagglutinin (HA) mRNA, partial cds | 1,167 bp linear mRNA | AY299500.1 GI: 32140388 |
| Influenza A virus (A/Seoul/15/2002(H1N1)) neuraminidase (NA) mRNA, complete cds | 1,449 bp linear mRNA | AY297140.1 GI: 31871988 |
| Influenza A virus (A/Seoul/15/2002(H1N1)) hemagglutinin (HA) mRNA, partial cds | 1,149 bp linear mRNA | AY299501.1 GI: 32140390 |
| Influenza A virus (A/Seoul/33/2002(H1N1)) neuraminidase (NA) mRNA, complete cds | 1,437 bp linear mRNA | AY310407.1 GI: 31872383 |
| Influenza A virus (A/Seoul/33/2002(H1N1)) hemagglutinin (HA) mRNA, partial cds | 1,167 bp linear mRNA | AY299495.1 GI: 32140378 |
| Influenza A virus (A/swine/Arnsberg/6554/1979(H1N1)) mRNA for hemagglutinin HA1 | 1,050 bp linear mRNA | Z46437.1 GI: 565609 |

TABLE 7-continued

Influenza H1N1 Antigens

| Strain/Protein | Length | GenBank/GI Accession No. |
|---|---|---|
| Influenza A virus (A/swine/Beijing/47/1991(H1N1)) hemagglutinin precursor (HA) mRNA, partial cds | 1,595 bp linear mRNA | U46783.1 GI: 1912330 |
| Influenza A virus (A/swine/Beijing/94/1991(H1N1)) nucleoprotein (NP) mRNA, complete cds | 1,565 bp linear mRNA | U49091.1 GI: 1912380 |
| Influenza A virus (A/swine/Belgium/1/83(H1N1)) segment 4 hemagglutinin precursor (HA) mRNA, complete cds | 1,778 bp linear mRNA | AF091316.1 GI: 4585174 |
| Influenza A virus (A/swine/Cotes d'Armor/0118/2006(H1N1)) partial mRNA for haemagglutinin precursor (HA1 gene) | 1,116 bp linear mRNA | AM490219.1 GI: 222062898 |
| Influenza A virus (A/swine/Cotes d'Armor/013618/2006(H1N1)) partial mRNA for haemagglutinin precursor (HA1 gene) | 1,043 bp linear mRNA | AM490223.1 GI: 222062906 |
| Influenza A virus (A/swine/Cotes d'Armor/0184/2006(H1N1)) partial mRNA for haemagglutinin precursor (HA1 gene) | 1,089 bp linear mRNA | AM490220.1 GI: 222062900 |
| Influenza A virus (A/swine/Cotes d'Armor/0227/2005(H1N1)) partial mRNA for haemagglutinin precursor (HA1 gene) | 1,068 bp linear mRNA | AM490221.1 GI: 222062902 |
| Influenza A virus (A/swine/Cotes d'Armor/0250/2006(H1N1)) partial mRNA for haemagglutinin precursor (HA1 gene) | 1,024 bp linear mRNA | AM490222.1 GI: 222062904 |
| Influenza A virus (A/swine/Cotes d'Armor/736/2001(H1N1)) partial HA gene for Haemagglutinin, genomic RNA | 1,011 bp linear mRNA | AJ517820.1 GI: 38422533 |
| Influenza A virus (A/Swine/England/195852/92 (H1N1)) neuraminidase (NA) gene, complete cds | 1,410 bp linear mRNA | AF250366.2 GI: 13260593 |
| Influenza A virus PB2 gene for Polymerase 2 protein, genomic RNA, strain A/Swine/Finistere/2899/82 | 2,268 bp linear mRNA | AJ311457.1 GI: 13661037 |
| Influenza A virus PB1 gene for Polymerase 1 protein, genomic RNA, strain A/Swine/Finistere/2899/82 | 2,341 bp linear mRNA | AJ311462.1 GI: 13661047 |
| Influenza A virus PA gene for Polymerase A protein, genomic RNA, strain A/Swine/Finistere/2899/82 | 2,233 bp linear mRNA | AJ311463.1 GI: 13661049 |
| Influenza A virus (A/swine/Finistere/2899/82(H1N1) M1 gene for matrix protein 1 and M2 gene for matrix protein 2, genomic RNA | 1,002 bp linear mRNA | AJ316059.1 GI: 20068128 |
| Influenza A virus (A/swine/Finistere/2899/82(H1N1)) NS1 gene for non structural protein 1 and NS2 gene for non structural protein 2, genomic RNA | 864 bp linear mRNA | AJ344037.1 GI: 20068185 |
| Influenza A virus (A/swine/Germany/2/1981(H1N1)) mRNA for PA polymerase | 838 bp linear mRNA | X75786.1 GI: 438106 |
| Influenza A virus (A/swine/Germany/2/1981(H1N1)) mRNA for neuraminidase (partial) | 305 bp linear mRNA | Z30277.1 GI: 530399 |
| Influenza A virus (A/swine/Germany/2/1981(H1N1)) mRNA for hemagglutinin | 1,730 bp linear mRNA | Z30276.1 GI: 563490 |
| 165. Influenza A virus (A/swine/Germany/8533/1991(H1N1)) mRNA for hemagglutinin precursor | 1,730 bp linear mRNA | Z46434.1 GI: 565611 |
| Influenza A virus (A/swine/Guangdong/711/2001(H1N1)) nonfunctional hemagglutinin (HA) mRNA, partial sequence | 1,690 bp linear mRNA | AY852271.1 GI: 60327789 |
| Influenza A virus (A/swine/Haseluenne/IDT2617/03(H1N1)) hemagglutinin mRNA, complete cds | 1,809 bp linear mRNA | EU163946.1 GI: 157679548 |
| Influenza A virus (A/swine/Hokkaido/2/81 (H1N1)) hemagglutinin precursor (HA) mRNA, partial cds | 981 bp linear mRNA | U47306.1 GI: 1912342 |
| Influenza A virus (A/swine/Hokkaido/2/81 (H1N1)) segment 4 hemagglutinin precursor (HA) mRNA, complete cds | 1,778 bp linear mRNA | AF091306.1 GI: 4585154 |
| Influenza A virus (A/swine/Hong Kong/168/1993(H1N1)) hemagglutinin precursor (HA) mRNA, partial cds | 1,113 bp linear mRNA | U44482.1 GI: 1912318 |

TABLE 7-continued

| Influenza H1N1 Antigens | | |
|---|---|---|
| Strain/Protein | Length | GenBank/GI Accession No. |
| Influenza A virus (A/swine/Hong Kong/168/1993(H1N1)) neuraminidase (NA) mRNA, partial cds | 416 bp linear mRNA | U47817.1 GI: 1912354 |
| Influenza A virus (A/swine/Hong Kong/168/1993(H1N1)) polymerase (PB2) mRNA, partial cds | 286 bp linear mRNA | U48286.1 GI: 1912358 |
| Influenza A virus (A/swine/Hong Kong/168/1993(H1N1)) polymerase (PB1) mRNA, partial cds | 379 bp linear mRNA | U48283.1 GI: 1912370 |
| Influenza A virus (A/swine/Hong Kong/168/1993(H1N1)) polymerase (PA) mRNA, partial cds | 308 bp linear mRNA | U48850.1 GI: 1912376 |
| Influenza A virus (A/swine/Hong Kong/168/1993(H1N1)) nucleoprotein (NP) mRNA, partial cds | 1,397 bp linear mRNA | U49096.1 GI: 1912390 |
| Influenza A virus (A/swine/Hong Kong/172/1993(H1N1)) hemagglutinin precursor (HA) mRNA, partial cds | 1,315 bp linear mRNA | U46020.1 GI: 1912324 |
| Influenza A virus (A/swine/Hong Kong/176/1993(H1N1)) hemagglutinin precursor (HA) mRNA, partial cds | 1,113 bp linear mRNA | U45451.1 GI: 1912320 |
| Influenza A virus (A/swine/Hong Kong/273/1994(H1N1)) hemagglutinin precursor (HA) mRNA, partial cds | 1,330 bp linear mRNA | U45452.1 GI: 1912322 |
| Influenza A virus (A/swine/Hong Kong/273/1994(H1N1)) neuraminidase (NA) mRNA, partial cds | 241 bp linear mRNA | U47818.1 GI: 1912356 |
| Influenza A virus (A/swine/Hong Kong/273/1994(H1N1)) polymerase (PB2) mRNA, partial cds | 328 bp linear mRNA | U48287.1 GI: 1912360 |
| Influenza A virus (A/swine/Hong Kong/273/1994(H1N1)) polymerase (PB1) mRNA, partial cds | 240 bp linear mRNA | U48282.1 GI: 1912368 |
| Influenza A virus (A/swine/Hong Kong/273/1994(H1N1)) polymerase (PA) mRNA, partial cds | 336 bp linear mRNA | U48851.1 GI: 1912378 |
| Influenza A virus (A/swine/Hong Kong/273/1994(H1N1)) nucleoprotein (NP) mRNA, partial cds | 1,422 bp linear mRNA | U49092.1 GI: 1912382 |
| Influenza A virus (A/swine/IDT/Re230/92hp(H1N1)) hemagglutinin mRNA, complete cds | 1,761 bp linear mRNA | EU163947.1 GI: 157679550 |
| Influenza A virus (A/swine/IN/1726/1988(H1N1)) nucleoprotein (segment 5) mRNA, complete cds | 1,550 bp linear mRNA | L46849.1 GI: 954755 |
| Influenza A virus (A/swine/Iowa/15/30(H1N1)) hemagglutinin precursor (HA) mRNA, partial cds | 981 bp linear mRNA | U47305.1 GI: 1912340 |
| Influenza A virus (A/swine/Iowa/15/30 (H1N1)) segment 4 hemagglutinin precursor (HA) mRNA, complete cds | 1,778 bp linear mRNA | AF091308.1 GI: 4585158 |
| Influenza A virus (A/Swine/Iowa/30 (H1N1)) neuraminidase (NA) gene, complete cds | 1,410 bp linear mRNA | AF250364.2 GI: 13260586 |
| Influenza A virus (A/swine/Iowa/17672/88 (H1N1)) hemagglutinin precursor (HA) mRNA, partial cds | 981 bp linear mRNA | U47304.1 GI: 1912338 |
| Influenza A virus (A/swine/Italy/3364/00(H1N1)) partial NS1 gene for non structural protein 1 and partial NS2 gene for non structural protein 2, genomic RNA | 864 bp linear mRNA | AJ519462.1 GI: 31096447 |
| Influenza A virus (A/swine/Italy-Virus/671/87(H1N1)) segment 4 hemagglutinin precursor (HA) mRNA, complete cds | 1,777 bp linear mRNA | AF091315.1 GI: 4585172 |
| Influenza A Virus (A/swine/Italy/v.147/1981(H1N1)) mRNA for hemagglutinin HA1 | 1,028 bp linear mRNA | Z46436.1 GI: 854214 |
| Influenza A virus (A/swine/Morbihan/0070/2005(H1N1)) partial mRNA for haemagglutinin precursor (HA1 gene) | 1,118 bp linear mRNA | AM490218.1 GI: 222062896 |
| Influenza A virus (A/swine/Nebraska/1/92(H1N1)) HA protein mRNA, complete cds | 1,770 bp linear mRNA | L09063.1 GI: 290722 |

TABLE 7-continued

| Influenza H1N1 Antigens | | |
|---|---|---|
| Strain/Protein | Length | GenBank/GI Accession No. |
| Influenza A virus (A/swine/Nebraska/1/1992(H1N1)) segment 5 nucleoprotein (NP) mRNA, complete cds | 1,550 bp linear mRNA | L11164.1 GI: 290724 |
| Influenza A virus (A/swine/Netherlands/12/1985(H1N1)) hemagglutinin (HA) mRNA, partial cds | 981 bp linear mRNA | U46943.1 GI: 1912336 |
| Influenza A virus (A/swine/Netherlands/12/85(H1N1)) segment 4 hemagglutinin precursor (HA) mRNA, complete cds | 1,776 bp linear mRNA | AF091317.1 GI: 4585176 |
| Influenza A virus (A/swine/Netherlands/25/1980(H1N1)) mRNA for nucleoprotein | 539 bp linear mRNA | X75791.1 GI: 438105 |
| Influenza A virus (A/swine/Netherlands/3/1980(H1N1)) hemagglutinin (HA) mRNA, partial cds | 981 bp linear mRNA | U46942.1 GI: 1912334 |
| Influenza A virus (A/swine/Netherlands/3/80(H1N1)) segment 4 hemagglutinin precursor (HA) mRNA, complete cds | 1,778 bp linear mRNA | AF091314.1 GI: 4585170 |
| Influenza A virus (A/NJ/11/76 (H1N1)) neuraminidase (NA) gene, complete cds | 1,410 bp linear mRNA | AF250363.2 GI: 13260583 |
| Influenza A virus (A/Swine/Quebec/192/81 (SwQc81)) neuraminidase mRNA, complete cds | 1,438 bp linear mRNA | U86144.1 GI: 4099318 |
| Influenza A virus (A/Swine/Quebec/5393/91 (SwQc91)) neuraminidase mRNA, complete cds | 1,438 bp linear mRNA | U86145.1 GI: 4099320 |
| Influenza A virus (A/swine/Schleswig-Holstein/1/1992(H1N1)) mRNA for hemagglutinin precursor | 1,730 bp linear mRNA | Z46435.1 GI: 854216 |
| Influenza A Virus (A/swine/Schleswig-Holstein/1/1993(H1N1)) mRNA for nucleoprotein | 1,554 bp linear mRNA | Z46438.1 GI: 854222 |
| Influenza A virus (A/swine/Wisconsin/1/61(H1N1)) segment 4 hemagglutinin precursor (HA) mRNA, complete cds | 1,778 bp linear mRNA | AF091307.1 GI: 4585156 |
| 212. Influenza A virus (A/swine/Wisconsin/1/1967(H1N1)) nucleoprotein mRNA, complete cds | 1,565 bp linear mRNA | M76607.1 GI: 325086 |
| Influenza A virus (A/swine/Wisconsin/1915/1988(H1N1)) nucleoprotein mRNA, complete cds | 1,565 bp linear mRNA | M76608.1 GI: 325088 |
| Influenza A virus (A/swine/WI/1915/1988(H1N1)) nucleoprotein (segment 5) mRNA, complete cds | 1,550 bp linear mRNA | L46850.1 GI: 954757 |
| Influenza A virus (A/Switzerland/8808/2002(H1N1)) partial m1 gene for matrix protein 1 and partial m2 gene for matrix protein 2, genomic RNA | 729 bp linear mRNA | AJ532568.1 GI: 31096461 |
| Influenza A virus (A/human/Taiwan/0012/00(H1N1)) hemagglutinin (HA) mRNA, partial cds | 561 bp linear mRNA | AF362803.1 GI: 14571975 |
| Influenza A virus (A/human/Taiwan/0016/00(H1N1)) hemagglutinin (HA) mRNA, partial cds | 561 bp linear mRNA | AF362779.1 GI: 14571927 |
| Influenza A virus (A/Taiwan/0016/2000 (H1N1)) polymerase basic protein 1 (PB1) mRNA, partial cds | 303 bp linear mRNA | AY303752.1 GI: 32330993 |
| Influenza A virus (A/human/Taiwan/0030/00(H1N1)) hemagglutinin (HA) mRNA, partial cds | 561 bp linear mRNA | AF362780.1 GI: 14571929 |
| Influenza A virus (A/Taiwan/0030/2000 (H1N1)) polymerase basic protein 1 (PB1) mRNA, partial cds | 303 bp linear mRNA | AY303704.1 GI: 32330897 |
| Influenza A virus (A/Taiwan/0032/2002(H1N1)) hemagglutinin mRNA, partial cds | 494 bp linear mRNA | AY604804.1 GI: 50727488 |
| Influenza A virus (A/Taiwan/0061/2002(H1N1)) hemagglutinin mRNA, partial cds | 494 bp linear mRNA | AY604795.1 GI: 50727470 |
| Influenza A virus (A/Taiwan/0069/2002(H1N1)) hemagglutinin mRNA, partial cds | 494 bp linear mRNA | AY604803.1 GI: 50727486 |
| Influenza A virus (A/Taiwan/0078/2002(H1N1)) hemagglutinin mRNA, partial cds | 494 bp linear mRNA | AY604805.1 GI: 50727490 |
| Influenza A virus (A/Taiwan/0094/2002(H1N1)) hemagglutinin mRNA, partial cds | 494 bp linear mRNA | AY604797.1 GI: 50727474 |
| Influenza A virus (A/Taiwan/0116/2002(H1N1)) hemagglutinin mRNA, partial cds | 494 bp linear mRNA | AY604796.1 GI: 50727472 |

TABLE 7-continued

| Influenza H1N1 Antigens | | |
|---|---|---|
| Strain/Protein | Length | GenBank/GI Accession No. |
| Influenza A virus (A/human/Taiwan/0130/96(H1N1)) hemagglutinin (HA) mRNA, partial cds | 564 bp linear mRNA | AF362781.1 GI: 14571931 |
| Influenza A virus (A/Taiwan/0130/96 (H1N1)) polymerase basic protein 1 (PB1) mRNA, partial cds | 303 bp linear mRNA | AY303707.1 GI: 32330903 |
| Influenza A virus (A/human/Taiwan/0132/96(H1N1)) hemagglutinin (HA) mRNA, partial cds | 564 bp linear mRNA | AF362782.1 GI: 14571933 |
| Influenza A virus (A/Taiwan/0132/96 (H1N1)) polymerase basic protein 1 (PB1) mRNA, partial cds | 303 bp linear mRNA | AY303708.1 GI: 32330905 |
| Influenza A virus (A/human/Taiwan/0211/96(H1N1)) hemagglutinin (HA) mRNA, partial cds | 564 bp linear mRNA | AF362783.1 GI: 14571935 |
| Influenza A virus (A/Taiwan/0211/96 (H1N1)) polymerase basic protein 1 (PB1) mRNA, partial cds | 303 bp linear mRNA | AY303709.1 GI: 32330907 |
| Influenza A virus (A/human/Taiwan/0235/96(H1N1)) hemagglutinin (HA) mRNA, partial cds | 564 bp linear mRNA | AF362784.1 GI: 14571937 |
| Influenza A virus (A/Taiwan/0235/96 (H1N1)) polymerase basic protein 1 (PB1) mRNA, partial cds | 303 bp linear mRNA | AY303710.1 GI: 32330909 |
| Influenza A virus (A/human/Taiwan/0255/96(H1N1)) hemagglutinin (HA) mRNA, partial cds | 564 bp linear mRNA | AF362785.1 GI: 14571939 |
| Influenza A virus (A/Taiwan/0255/96 (H1N1)) polymerase basic protein 1 (PB1) mRNA, partial cds | 303 bp linear mRNA | AY303711.1 GI: 32330911 |
| Influenza A virus (A/human/Taiwan/0337/96(H1N1)) hemagglutinin (HA) mRNA, partial cds | 564 bp linear mRNA | AF362786.1 GI: 14571941 |
| Influenza A virus (A/human/Taiwan/0342/96(H1N1)) hemagglutinin (HA) mRNA, partial cds | 564 bp linear mRNA | AF362787.1 GI: 14571943 |
| Influenza A virus (A/Taiwan/0342/96 (H1N1)) polymerase basic protein 1 (PB1) mRNA, partial cds | 303 bp linear mRNA | AY303714.1 GI: 32330917 |
| Influenza A virus (A/human/Taiwan/0464/99(H1N1)) hemagglutinin (HA) mRNA, partial cds | 561 bp linear mRNA | AF362788.1 GI: 14571945 |
| Influenza A virus (A/human/Taiwan/0562/95(H1N1)) hemagglutinin (HA) mRNA, partial cds | 564 bp linear mRNA | AF362789.1 GI: 14571947 |
| Influenza A virus (A/Taiwan/0562/95 (H1N1)) polymerase basic protein 1 (PB1) mRNA, partial cds | 303 bp linear mRNA | AY303720.1 GI: 32330929 |
| Influenza A virus (A/human/Taiwan/0563/95(H1N1)) hemagglutinin (HA) mRNA, partial cds | 564 bp linear mRNA | AF362790.1 GI: 14571949 |
| Influenza A virus (A/Taiwan/0563/95 (H1N1)) polymerase basic protein 1 (PB1) mRNA, partial cds | 303 bp linear mRNA | AY303721.1 GI: 32330931 |
| Influenza A virus (A/human/Taiwan/0657/95(H1N1)) hemagglutinin (HA) mRNA, partial cds | 564 bp linear mRNA | AF362791.1 GI: 14571951 |
| Influenza A virus (A/Taiwan/0657/95 (H1N1)) polymerase basic protein 1 (PB1) mRNA, partial cds | 303 bp linear mRNA | AY303724.1 GI: 32330937 |
| Influenza A virus (A/Taiwan/0859/2002(H1N1)) hemagglutinin mRNA, partial cds | 494 bp linear mRNA | AY604801.1 GI: 50727482 |
| Influenza A virus (A/human/Taiwan/0892/99(H1N1)) hemagglutinin (HA) mRNA, partial cds | 561 bp linear mRNA | AF362792.1 GI: 14571953 |
| Influenza A virus (A/Taiwan/0983/2002(H1N1)) hemagglutinin mRNA, partial cds | 494 bp linear mRNA | AY604800.1 GI: 50727480 |
| Influenza A virus (A/Taiwan/1007/2006(H1N1)) hemagglutinin (HA) mRNA, partial cds | 507 bp linear mRNA | EU068163.1 GI: 158452199 |
| Influenza A virus (A/Taiwan/1015/2006(H1N1)) hemagglutinin (HA) mRNA, partial cds | 507 bp linear mRNA | EU068171.1 GI: 158452215 |
| Influenza A virus (A/Taiwan/112/1996-1(H1N1)) haemagglutinin (HA) mRNA, partial cds | 1,176 bp linear mRNA | AF026153.1 GI: 2554950 |
| Influenza A virus (A/Taiwan/112/1996-2(H1N1)) haemagglutinin (HA) mRNA, partial cds | 1,176 bp linear mRNA | AF026154.1 GI: 2554952 |

TABLE 7-continued

| Influenza H1N1 Antigens | | |
|---|---|---|
| Strain/Protein | Length | GenBank/GI Accession No. |
| Influenza A virus (A/Taiwan/117/1996-1(H1N1)) haemagglutinin (HA) mRNA, partial cds | 1,176 bp linear mRNA | AF026155.1 GI: 2554954 |
| Influenza A virus (A/Taiwan/117/1996-2(H1N1)) haemagglutinin (HA) mRNA, partial cds | 1,176 bp linear mRNA | AF026156.1 GI: 2554956 |
| Influenza A virus (A/Taiwan/117/1996-3(H1N1)) haemagglutinin (HA) mRNA, partial cds | 1,176 bp linear mRNA | AF026157.1 GI: 2554958 |
| Influenza A virus (A/Taiwan/118/1996-1(H1N1)) haemagglutinin (HA) mRNA, partial cds | 1,176 bp linear mRNA | AF026158.1 GI: 2554960 |
| Influenza A virus (A/Taiwan/118/1996-2(H1N1)) haemagglutinin (HA) mRNA, partial cds | 1,176 bp linear mRNA | AF026159.1 GI: 2554962 |
| Influenza A virus (A/Taiwan/118/1996-3(H1N1)) haemagglutinin (HA) mRNA, partial cds | 1,176 bp linear mRNA | AF026160.1 GI: 2554964 |
| Influenza A virus (A/human/Taiwan/1184/99(HIN1)) hemagglutinin (HA) mRNA, partial cds | 561 bp linear mRNA | AF362793.1 GI: 14571955 |
| Influenza A virus (A/Taiwan/1184/99 (H1N1)) polymerase basic protein 1 (PB1) mRNA, partial cds | 303 bp linear mRNA | AY303726.1 GI: 32330941 |
| Influenza A virus (A/human/Taiwan/1190/95(H1N1)) hemagglutinin (HA) mRNA, partial cds | 564 bp linear mRNA | AF362794.1 GI: 14571957 |
| Influenza A virus (A/Taiwan/1190/95 (H1N1)) polymerase basic protein 1 (PB1) mRNA, partial cds | 303 bp linear mRNA | AY303727.1 GI: 32330943 |
| Influenza A virus (A/Taiwan/1523/2003(H1N1)) hemagglutinin mRNA, partial cds | 494 bp linear mRNA | AY604808.1 GI: 50727496 |
| Influenza A virus (A/Taiwan/1566/2003(H1N1)) hemagglutinin mRNA, partial cds | 494 bp linear mRNA | AY604806.1 GI: 50727492 |
| Influenza A virus (A/Taiwan/1769/96(H1N1)) matrix protein M1 (M) mRNA, partial cds | 875 bp linear mRNA | AF138710.2 GI: 4996871 |
| Influenza A virus (A/Taiwan/1906/2002(H1N1)) hemagglutinin mRNA, partial cds | 494 bp linear mRNA | AY604799.1 GI: 50727478 |
| Influenza A virus (A/Taiwan/1922/2002(H1N1)) hemagglutinin mRNA, partial cds | 494 bp linear mRNA | AY604802.1 GI: 50727484 |
| Influenza A virus (A/Taiwan/2069/2006(H1N1)) hemagglutinin (HA) mRNA, partial cds | 507 bp linear mRNA | EU068168.1 GI: 158452209 |
| Influenza A virus (A/Taiwan/2157/2001 (H1N1)) polymerase basic protein 1 (PB1) mRNA, partial cds | 303 bp linear mRNA | AY303733.1 GI: 32330955 |
| Influenza A virus (A/Taiwan/2175/2001 (H1N1)) hemagglutinin (HA) mRNA, partial cds | 561 bp linear mRNA | AY303734.1 GI: 32330957 |
| Influenza A virus (A/human/Taiwan/2200/95(H1N1)) hemagglutinin (HA) mRNA, partial cds | 564 bp linear mRNA | AF362795.1 GI: 14571959 |
| Influenza A virus (A/Taiwan/2200/95 (H1N1)) polymerase basic protein 1 (PB1) mRNA, partial cds | 303 bp linear mRNA | AY303737.1 GI: 32330963 |
| Influenza A virus (A/Taiwan/2966/2006(H1N1)) hemagglutinin (HA) mRNA, partial cds | 507 bp linear mRNA | EU068170.1 GI: 158452213 |
| Influenza A virus (A/Taiwan/3168/2005(H1N1)) hemagglutinin (HA) mRNA, partial cds | 507 bp linear mRNA | EU068174.1 GI: 158452221 |
| Influenza A virus (A/human/Taiwan/3355/97(H1N1)) hemagglutinin (HA) mRNA, partial cds | 561 bp linear mRNA | AF362796.1 GI: 14571961 |
| Influenza A virus (A/Taiwan/3355/97 (H1N1)) polymerase basic protein 1 (PB1) mRNA, partial cds | 303 bp linear mRNA | AY303739.1 GI: 32330967 |
| Influenza A virus (A/Taiwan/3361/2001 (H1N1)) polymerase basic protein 1 (PB1) mRNA, partial cds | 303 bp linear mRNA | AY303740.1 GI: 32330969 |
| Influenza A virus (A/Taiwan/3361/2001 (H1N1)) hemagglutinin (HA) mRNA, partial cds | 561 bp linear mRNA | AY303741.1 GI: 32330971 |
| Influenza A virus (A/Taiwan/3518/2006(H1N1)) hemagglutinin (HA) mRNA, partial cds | 507 bp linear mRNA | EU068169.1 GI: 158452211 |
| Influenza A virus (A/human/Taiwan/3825/00(H1N1)) hemagglutinin (HA) mRNA, partial cds | 581 bp linear mRNA | AF362797.1 GI: 14571963 |
| Influenza A virus (A/Taiwan/3896/2001 (H1N1)) polymerase basic protein 1 (PB1) mRNA, partial cds | 303 bp linear mRNA | AY303746.1 GI: 32330981 |
| Influenza A virus (A/Taiwan/3896/2001 (H1N1)) hemagglutinin (HA) mRNA, partial cds | 561 bp linear mRNA | AY303747.1 GI: 32330983 |
| Influenza A virus (A/Taiwan/4050/2003(H1N1)) hemagglutinin mRNA, partial cds | 494 bp linear mRNA | AY604807.1 GI: 50727494 |
| Influenza A virus (A/Taiwan/4054/2006(H1N1)) | 507 bp | EU068160.1 |

TABLE 7-continued

Influenza H1N1 Antigens

| Strain/Protein | Length | GenBank/GI Accession No. |
|---|---|---|
| hemagglutinin (HA) mRNA, partial cds | linear mRNA | GI: 158452193 |
| Influenza A virus (A/human/Taiwan/4360/99(H1N1)) hemagglutinin (HA) mRNA, partial cds | 561 bp linear mRNA | AF362798.1 GI: 14571965 |
| Influenza A virus (A/Taiwan/4360/99 (H1N1)) polymerase basic protein 1 (PB1) mRNA, partial cds | 303 bp linear mRNA | AY303748.1 GI: 32330985 |
| Influenza A virus (A/human/Taiwan/4415/99(H1N1)) hemagglutinin (HA) mRNA, partial cds | 561 bp linear mRNA | AF362799.1 GI: 14571967 |
| Influenza A virus (A/Taiwan/4415/99 (H1N1)) polymerase basic protein 1 (PB1) mRNA, partial cds | 303 bp linear mRNA | AY303749.1 GI: 32330987 |
| Influenza A virus (A/Taiwan/4509/2006(H1N1)) hemagglutinin (HA) mRNA, partial cds | 507 bp linear mRNA | EU068165.1 GI: 158452203 |
| Influenza A virus (A/human/Taiwan/4845/99(H1N1)) hemagglutinin (HA) mRNA, partial cds | 561 bp linear mRNA | AF362800.1 GI: 14571969 |
| Influenza A virus (A/Taiwan/4845/99 (H1N1)) polymerase basic protein 1 (PB1) mRNA, partial cds | 303 bp linear mRNA | AY303750.1 GI: 32330989 |
| Influenza A virus (A/human/Taiwan/4943/99(H1N1)) hemagglutinin (HA) mRNA, partial cds | 561 bp linear mRNA | AF362801.1 GI: 14571971 |
| Influenza A virus (A/Taiwan/5010/2006(H1N1)) hemagglutinin (HA) mRNA, partial cds | 507 bp linear mRNA | EU068167.1 GI: 158452207 |
| Influenza A virus (A/human/Taiwan/5063/99(H1N1)) hemagglutinin (HA) mRNA, partial cds | 561 bp linear mRNA | AF362802.1 GI: 14571973 |
| Influenza A virus (A/Taiwan/5063/99 (H1N1)) polymerase basic protein 1 (PB1) mRNA, partial cds | 303 bp linear mRNA | AY303751.1 GI: 32330991 |
| Influenza A virus (A/Taiwan/5084/2006(H1N1)) hemagglutinin (HA) mRNA, partial cds | 507 bp linear mRNA | EU068166.1 GI: 158452205 |
| Influenza A virus (A/Taiwan/511/96(H1N1)) matrix protein M1 (M) mRNA, partial cds | 875 bp linear mRNA | AF138708.2 GI: 4996867 |
| Influenza A virus (A/Taiwan/557/2006(H1N1)) hemagglutinin (HA) mRNA, partial cds | 507 bp linear mRNA | EU068156.1 GI: 158452185 |
| Influenza A virus (A/Taiwan/562/2006(H1N1)) hemagglutinin (HA) mRNA, partial cds | 507 bp linear mRNA | EU068159.1 GI: 158452191 |
| Influenza A virus (A/human/Taiwan/5779/98(H1N1)) hemagglutinin (HA) mRNA, partial cds | 561 bp linear mRNA | AF362778.1 GI: 14571925 |
| Influenza A virus (A/Taiwan/5779/98 (H1N1)) polymerase basic protein 1 (PB1) mRNA, partial cds | 303 bp linear mRNA | AY303702.1 GI: 32330893 |
| Influenza A virus (A/Taiwan/6025/2005(H1N1)) hemagglutinin (HA) mRNA, partial cds | 507 bp linear mRNA | EU068172.1 GI: 158452217 |
| Influenza A virus (A/Taiwan/607/2006(H1N1)) hemagglutinin (HA) mRNA, partial cds | 507 bp linear mRNA | EU068157.1 GI: 158452187 |
| Influenza A virus (A/Taiwan/615/2006(H1N1)) hemagglutinin (HA) mRNA, partial cds | 507 bp linear mRNA | EU068162.1 GI: 158452197 |
| Influenza A virus (A/Taiwan/645/2006(H1N1)) hemagglutinin (HA) mRNA, partial cds | 507 bp linear mRNA | EU068164.1 GI: 158452201 |
| Influenza A virus (A/Taiwan/680/2005(H1N1)) hemagglutinin (HA) mRNA, partial cds | 507 bp linear mRNA | EU068173.1 GI: 158452219 |
| Influenza A virus (A/Taiwan/719/2006(H1N1)) hemagglutinin (HA) mRNA, partial cds | 507 bp linear mRNA | EU068158.1 GI: 158452189 |
| Influenza A virus (A/Thailand/CU124/2006(H3N2)) neuraminidase (NA) mRNA, complete cds | 1,410 bp linear mRNA | EU021285.1 GI: 154224724 |
| Influenza A virus (A/Thailand/CU32/2006(H1N1)) neuraminidase (NA) mRNA, complete cds | 1,413 bp linear mRNA | EU021265.1 GI: 154224704 |
| Influenza A virus (A/Thailand/CU32/2006(H1N1)) hemagglutinin (HA) mRNA, complete cds | 1,698 bp linear mRNA | EU021264.1 GI: 154224775 |
| Influenza A virus (A/Thailand/CU41/2006(H1N1)) neuraminidase (NA) mRNA, complete cds | 1,413 bp linear mRNA | EU021247.1 GI: 154224686 |
| Influenza A virus (A/Thailand/CU41/2006(H1N1)) hemagglutinin (HA) mRNA, complete cds | 1,698 bp linear mRNA | EU021246.1 GI: 154224757 |

TABLE 7-continued

| Influenza H1N1 Antigens | | |
|---|---|---|
| Strain/Protein | Length | GenBank/GI Accession No. |
| Influenza A virus (A/Thailand/CU44/2006(H1N1)) neuraminidase (NA) mRNA, complete cds | 1,413 bp linear mRNA | EU021259.1 GI: 154224698 |
| Influenza A virus (A/Thailand/CU44/2006(H1N1)) hemagglutinin (HA) mRNA, complete cds | 1,698 bp linear mRNA | EU021258.1 GI: 154224769 |
| Influenza A virus (A/Thailand/CU51/2006(H1N1)) neuraminidase (NA) mRNA, complete cds | 1,413 bp linear mRNA | EU021255.1 GI: 154224694 |
| Influenza A virus (A/Thailand/CU51/2006(H1N1)) hemagglutinin (HA) mRNA, complete cds | 1,698 bp linear mRNA | EU021254.1 GI: 154224765 |
| Influenza A virus (A/Thailand/CU53/2006(H1N1)) neuraminidase (NA) mRNA, complete cds | 1,413 bp linear mRNA | EU021249.1 GI: 154224688 |
| Influenza A virus (A/Thailand/CU53/2006(H1N1)) hemagglutinin (HA) mRNA, complete cds | 1,698 bp linear mRNA | EU021248.1 GI: 154224759 |
| Influenza A virus (A/Thailand/CU57/2006(H1N1)) neuraminidase (NA) mRNA, complete cds | 1,413 bp linear mRNA | EU021257.1 GI: 154224696 |
| Influenza A virus (A/Thailand/CU57/2006(H1N1)) hemagglutinin (HA) mRNA, complete cds | 1,698 bp linear mRNA | EU021256.1 GI: 154224767 |
| Influenza A virus (A/Thailand/CU67/2006(H1N1)) neuraminidase (NA) mRNA, complete cds | 1,413 bp linear mRNA | EU021251.1 GI: 154224690 |
| Influenza A virus (A/Thailand/CU67/2006(H1N1)) hemagglutinin (HA) mRNA, complete cds | 1,698 bp linear mRNA | EU021250.1 GI: 154224761 |
| Influenza A virus (A/Thailand/CU68/2006(H1N1)) neuraminidase (NA) mRNA, complete cds | 1,413 bp linear mRNA | EU021261.1 GI: 154224700 |
| Influenza A virus (A/Thailand/CU68/2006(H1N1)) hemagglutinin (HA) mRNA, complete cds | 1,698 bp linear mRNA | EU021260.1 GI: 154224771 |
| Influenza A virus (A/Thailand/CU75/2006(H1N1)) neuraminidase (NA) mRNA, complete cds | 1,413 bp linear mRNA | EU021263.1 GI: 154224702 |
| Influenza A virus (A/Thailand/CU75/2006(H1N1)) hemagglutinin (HA) mRNA, complete cds | 1,698 bp linear mRNA | EU021262.1 GI: 154224773 |
| Influenza A virus (A/Thailand/CU88/2006(H1N1)) neuraminidase (NA) mRNA, complete cds | 1,413 bp linear mRNA | EU021253.1 GI: 154224692 |
| Influenza A virus (A/Thailand/CU88/2006(H1N1)) hemagglutinin (HA) mRNA, complete cds | 1,698 bp linear mRNA | EU021252.1 GI: 154224763 |
| Influenza A virus (A/turkey/England/647/1977(H1N1)) nucleoprotein mRNA, complete cds | 1,565 bp linear mRNA | M76603.1 GI: 325094 |
| Influenza A virus (A/turkey/France/87075/87(H1N1)) N1 gene for neuraminidase, genomic RNA | 1,445 bp linear mRNA | AJ416626.1 GI: 39840719 |
| Influenza A virus (A/turkey/Germany/3/91(H1N1)) mRNA for PB2 polymerase (partial) | 394 bp linear mRNA | Z30272.1 GI: 456652 |
| Influenza A virus (A/turkey/Germany/3/91(H1N1)) mRNA for neuraminidase (UTR) | 97 bp linear mRNA | Z30275.1 GI: 530398 |
| Influenza A virus (A/turkey/Germany/3/91(H1N1)) mRNA for PA polymerase | 264 bp linear mRNA | Z30274.1 GI: 530401 |
| Influenza A virus (A/turkey/Germany/3/91(H1N1)) mRNA for PBI polymerase (partial) | 247 bp linear mRNA | Z30273.1 GI: 530403 |
| Influenza A virus (A/turkey/Germany/3/91(H1N1)) mRNA for hemagglutinin HA1 | 1,038 bp linear mRNA | Z46441.1 GI: 854218 |
| Influenza A virus (A/turkey/Minnesota/1661/1981(H1N1)) hemagglutinin (HA) mRNA, partial cds | 981 bp linear mRNA | U46941.1 GI: 1912332 |
| Influenza A virus (A/turkey/Minnesota/1661/81(H1N1)) segment 4 hemagglutinin precursor (HA) mRNA, complete cds | 1,777 bp linear mRNA | AF091310.1 GI: 4585162 |

TABLE 7-continued

Influenza H1N1 Antigens

| Strain/Protein | Length | GenBank/GI Accession No. |
|---|---|---|
| Influenza A virus (A/turkey/North Carolina/1790/1988(H1N1)) nucleoprotein mRNA, complete cds | 1,565 bp linear mRNA | M7 6609.1 GI: 325096 |
| Influenza A virus (A/Weiss/43 (H1N1)) neuraminidase (NA) gene, complete cds | 1,410 bp linear mRNA | AF250365.2 GI: 13260589 |
| Influenza A virus (A/Wilson-Smith/1933(H1N1)) nucleocapsid protein (NP) mRNA, complete cds | 1,497 bp linear mRNA | EU330203.1 GI: 167989512 |
| Influenza A virus (A/Wisconsin/3523/1988(H1N1)) neuraminidase (NA) mRNA, partial cds | 241 bp linear mRNA | U47816.1 GI: 1912352 |
| Influenza A virus (A/Wisconsin/3623/1988(H1N1)) nucleoprotein mRNA, complete cds | 1,565 bp linear mRNA | M7 6610.1 GI: 325103 |
| Influenza A virus (A/WI/4754/1994(H1N1)) PB1 (PB1) mRNA, partial cds | 235 bp linear mRNA | U53156.1 GI: 1399590 |
| Influenza A virus (A/WI/4754/1994(H1N1)) PB2 (PB2) mRNA, partial cds | 168 bp linear mRNA | U53158.1 GI: 1399594 |
| Influenza A virus (A/WI/4754/1994(H1N1)) PA (PA) mRNA, partial cds | 621 bp linear mRNA | U53160.1 GI: 1399598 |
| Influenza A virus (A/WI/4754/1994(H1N1)) hemagglutinin (HA) mRNA, complete cds | 1,778 bp linear mRNA | U53162.1 GI: 1399602 |
| Influenza A virus (A/WI/4754/1994(H1N1)) NP (NP) mRNA, partial cds | 200 bp linear mRNA | U53164.1 GI: 1399606 |
| Influenza A virus (A/WI/4754/1994(H1N1)) neuraminidase (NA) mRNA, complete cds | 1,458 bp linear mRNA | U53166.1 GI: 1399610 |
| Influenza A virus (A/WI/4754/1994(H1N1)) M (M) mRNA, complete cds | 1,027 bp linear mRNA | U53168.1 GI: 1399614 |
| Influenza A virus (A/WI/4754/1994(H1N1)) NS (NS) mRNA, complete cds | 890 bp linear mRNA | U53170.1 GI: 1399618 |
| Influenza A virus (A/WI/4755/1994(H1N1)) PB1 (PB1) mRNA, partial cds | 203 bp linear mRNA | U53157.1 GI: 1399592 |
| Influenza A virus (A/WI/4755/1994(H1N1)) PB2 (PB2) mRNA, partial cds | 173 bp linear mRNA | U53159.1 GI: 1399596 |
| Influenza A virus (A/WI/4755/1994(H1N1)) PA (PA) mRNA, partial cds | 621 bp linear mRNA | U53161.1 GI: 1399600 |
| Influenza A virus (A/WI/4755/1994(H1N1)) hemagglutinin (HA) mRNA, complete cds | 1,778 bp linear mRNA | U53163.1 GI: 1399604 |
| Influenza A virus (A/WI/4755/1994(H1N1)) NP (NP) mRNA, partial cds | 215 bp linear mRNA | U53165.1 GI: 1399608 |
| Influenza A virus (A/WI/4755/1994(H1N1)) neuraminidase (NA) mRNA, partial cds | 209 bp linear mRNA | U53167.1 GI: 1399612 |
| Influenza A virus (A/WI/4755/1994(H1N1)) M (M) mRNA, complete cds | 1,027 bp linear mRNA | U53169.1 GI: 1399616 |
| Influenza A virus (A/WI/4755/1994(H1N1)) NS (NS) mRNA, complete cds | 890 bp linear mRNA | U53171.1 GI: 1399620 |
| Influenza A virus (A/WSN/33) segment 5 nucleocapsid protein (NP) mRNA, partial cds | 543 bp linear mRNA | AF306656.1 GI: 11935089 |

TABLE 8

Influenza H3N2 Antigens

| Strain/Protein | Length | GenBank/GI Accession No. |
|---|---|---|
| 1. Influenza A virus (A/Aichi/2/1968(H3N2)) hemagglutinin (HA) mRNA, complete cds | 1,704 bp linear mRNA | EF614248.1 GI: 148910819 |
| 2. Influenza A virus (A/Aichi/2/1968(H3N2)) hemagglutinin (HA) mRNA, partial cds | 1,698 bp linear mRNA | EF614249.1 GI: 148910821 |
| 3. Influenza A virus (A/Aichi/2/1968(H3N2)) hemagglutinin (HA) mRNA, partial cds | 1,698 bp linear mRNA | EF614250.1 GI: 148910823 |
| 4. Influenza A virus (A/Aichi/2/1968(H3N2)) hemagglutinin (HA) mRNA, partial cds | 1,698 bp linear mRNA | EF614251.1 GI: 148910825 |
| 5. Influenza A virus (A/Akita/1/1995(H3N2)) haemagglutinin mRNA, partial cds | 1,032 bp linear mRNA | U48444.1 GI: 1574989 |
| 6. Influenza A virus (A/Beijing/32/1992(H3N2)) mRNA for haemagglutinin | 1,041 bp linear mRNA | Z46392.1 GI: 609020 |
| 7. Influenza A virus (A/Canada/33312/99(H3N2)) hemagglutinin (HA) mRNA, partial cds | 987 bp linear mRNA | AF501516.1 GI: 21314288 |

TABLE 8-continued

| Influenza H3N2 Antigens | | |
|---|---|---|
| Strain/Protein | Length | GenBank/GI Accession No. |
| 8. Influenza A virus (A/Charlottesville/10/99 (H3N2)) hemagglutinin mRNA, partial cds | 987 bp linear mRNA | AF297094.1 GI: 11228917 |
| 9. Influenza A virus (A/Charlottesville/49/99 (H3N2)) hemagglutinin mRNA, partial cds | 987 bp linear mRNA | AF297096.1 GI: 11228921 |
| 10. Influenza A virus (A/Charlottesville/69/99 (H3N2)) hemagglutinin mRNA, partial cds | 987 bp linear mRNA | AF297097.1 GI: 11228923 |
| 11. Influenza A virus (A/Charlottesville/73/99 (H3N2)) hemagglutinin mRNA, partial cds | 987 bp linear mRNA | AF297095.1 GI: 11228919 |
| 12. Influenza A virus (A/England/1/1993(H3N2)) mRNA for haemagglutinin | 1,041 bp linear mRNA | Z46393.1 GI: 609024 |
| 13. Influenza A virus (A/England/247/1993(H3N2)) mRNA for haemagglutinin | 1,041 bp linear mRNA | Z46394.1 GI: 609025 |
| 14. Influenza A virus (A/England/269/93(H3N2)) mRNA for haemagglutinin | 1,041 bp linear mRNA | Z46395.1 GI: 609027 |
| 15. Influenza A virus (A/England/284/1993(H3N2)) mRNA for haemagglutinin | 1,041 bp linear mRNA | Z46396.1 GI: 609029 |
| 16. Influenza A virus (A/England/286/1993(H3N2)) mRNA for haemagglutinin | 1,041 bp linear mRNA | Z46397.1 GI: 609031 |
| 17. Influenza A virus (A/England/289/1993(H3N2)) mRNA for haemagglutinin | 1,041 bp linear mRNA | Z46398.1 GI: 609033 |
| 18. Influenza A virus (A/England/328/1993(H3N2)) mRNA for haemagglutinin | 1,041 bp linear mRNA | Z46399.1 GI: 609035 |
| 19. Influenza A virus (A/England/346/1993(H3N2)) mRNA for haemagglutinin | 1,041 bp linear mRNA | Z46400.1 GI: 609037 |
| 20. Influenza A virus (A/England/347/1993(H3N2)) mRNA for haemagglutinin | 1,041 bp linear mRNA | Z46401.1 GI: 609039 |
| 21. Influenza A virus (A/England/42/72(H3N2)) hemagglutinin mRNA, partial cds | 1,091 bp linear mRNA | AF201875.1 GI: 6470274 |
| 22. Influenza A virus (A/England/471/1993(H3N2)) mRNA for haemagglutinin | 1,041 bp linear mRNA | Z46402.1 GI: 609041 |
| 23. Influenza A virus (A/England/67/1994(H3N2)) mRNA for haemagglutinin | 1,041 bp linear mRNA | Z46403.1 GI: 609043 |
| 24. Influenza A virus (A/England/68/1994(H3N2)) mRNA for haemagglutinin | 1,041 bp linear mRNA | Z46404.1 GI: 609045 |
| 25. Influenza A virus (A/England/7/1994(H3N2)) mRNA for haemagglutinin | 1,041 bp linear mRNA | Z46405.1 GI: 609047 |
| 28. Influenza A virus (A/Guangdong/25/1993(H3N2)) mRNA for haemagglutinin | 1,041 bp linear mRNA | Z46406.1 GI: 609049 |
| 29. Influenza A virus (A/Hong Kong/1/68(H3N2)) hemagglutinin mRNA, partial cds | 1,091 bp linear mRNA | AF201874.1 GI: 6470272 |
| 30. Influenza A virus (A/Hong Kong/1/1994(H3N2)) mRNA for haemagglutinin | 1,041 bp linear mRNA | Z46407.1 GI: 609051 |
| 31. Influenza A virus (A/Hong Kong/1143/99(H3N2)) hemagglutinin mRNA, complete cds | 1,762 bp linear mRNA | AF382319.1 GI: 14487957 |
| 32. Influenza A virus (A/Hong Kong/1143/99(H3N2)) hemagglutinin mRNA, complete cds | 1,762 bp linear mRNA | AF382320.1 GI: 14487959 |
| 33. Influenza A virus (A/Hong Kong/1143/99(H3N2)) neuraminidase mRNA, complete cds | 1,466 bp linear mRNA | AF382329.1 GI: 14487977 |
| 34. Influenza A virus (A/Hong Kong/1143/99(H3N2)) neuraminidase mRNA, complete cds | 1,466 bp linear mRNA | AF382330.1 GI: 14487979 |

TABLE 8-continued

| Influenza H3N2 Antigens | | |
|---|---|---|
| Strain/Protein | Length | GenBank/GI Accession No. |
| 35. Influenza A virus (A/Hong Kong/1144/99(H3N2)) hemagglutinin mRNA, complete cds | 1,762 bp linear mRNA | AY035589.1 GI: 14486403 |
| 36. Influenza A virus (A/Hong Kong/1144/99(H3N2)) hemagglutinin mRNA, complete cds | 1,762 bp linear mRNA | AF382321.1 GI: 14487961 |
| 37. Influenza A virus (A/Hong Kong/1144/99(H3N2)) hemagglutinin mRNA, complete cds | 1,762 bp linear mRNA | AF382322.1 GI: 14487963 |
| 38. Influenza A virus (A/Hong Kong/1144/99(H3N2)) neuraminidase mRNA, complete cds | 1,466 bp linear mRNA | AF382331.1 GI: 14487981 |
| 39. Influenza A virus (A/Hong Kong/1144/99(H3N2)) neuraminidase mRNA, complete cds | 1,466 bp linear mRNA | AF382332.1 GI: 14487983 |
| 40. Influenza A virus (A/Hong Kong/1179/99(H3N2)) hemagglutinin mRNA, complete cds | 1,762 bp linear mRNA | AY035590.1 GI: 14486405 |
| 41. Influenza A virus (A/Hong Kong/1179/99(H3N2)) hemagglutinin mRNA, complete cds | 1,762 bp linear mRNA | AF382323.1 GI: 14487965 |
| 42. Influenza A virus (A/Hong Kong/1179/99(H3N2)) hemagglutinin mRNA, complete cds | 1,762 bp linear mRNA | AF382324.1 GI: 14487967 |
| 43. Influenza A virus (A/Hong Kong/1180/99(H3N2)) hemagglutinin mRNA, complete cds | 1,762 bp linear mRNA | AY035591.1 GI: 14486407 |
| 44. Influenza A virus (A/Hong Kong/1180/99(H3N2)) hemagglutinin mRNA, complete cds | 1,762 bp linear mRNA | AF382325.1 GI: 14487969 |
| 45. Influenza A virus (A/Hong Kong/1180/99(H3N2)) hemagglutinin mRNA, complete cds | 1,762 bp linear mRNA | AF382326.1 GI: 14487971 |
| 46. Influenza A virus (A/Hong Kong/1182/99(H3N2)) hemagglutinin mRNA, complete cds | 1,762 bp linear mRNA | AF382327.1 GI: 14487973 |
| 47. Influenza A virus (A/Hong Kong/1182/99(H3N2)) hemagglutinin mRNA, complete cds | 1,762 bp linear mRNA | AF382328.1 GI: 14487975 |
| 48. Influenza A virus (A/Hong Kong/2/1994(H3N2)) mRNA for haemagglutinin | 1,041 bp linear mRNA | Z46408.1 GI: 609055 |
| 49. Influenza A virus (A/Hong Kong/23/1992(H3N2)) mRNA for haemagglutinin | 1,041 bp linear mRNA | Z46410.1 GI: 609053 |
| 50. Influenza A virus (A/Hong Kong/34/1990(H3N2)) mRNA for haemagglutinin | 1,041 bp linear mRNA | Z46409.1 GI: 609057 |
| 51. Influenza A virus (A/England/286/1993(H3N2)) mRNA for haemagglutinin | 1,041 bp linear mRNA | Z46397.1 GI: 609031 |
| 52. Influenza A virus (A/England/289/1993(H3N2)) mRNA for haemagglutinin | 1,041 bp linear mRNA | Z46398.1 GI: 609033 |
| 53. Influenza A virus (A/England/328/1993(H3N2)) mRNA for haemagglutinin | 1,041 bp linear mRNA | Z46399.1 GI: 609035 |
| 54. Influenza A virus (A/England/346/1993(H3N2)) mRNA for haemagglutinin | 1,041 bp linear mRNA | Z46400.1 GI: 609037 |
| 55. Influenza A virus (A/England/347/1993(H3N2)) mRNA for haemagglutinin | 1,041 bp linear mRNA | Z46401.1 GI: 609039 |
| 56. Influenza A virus (A/England/42/72(H3N2)) hemagglutinin mRNA, partial cds | 1,091 bp linear mRNA | AF201875.1 GI: 6470274 |
| 57. Influenza A virus (A/England/471/1993(H3N2)) mRNA for haemagglutinin | 1,041 bp linear mRNA | Z46402.1 GI: 609041 |
| 58. Influenza A virus (A/England/67/1994(H3N2)) mRNA for haemagglutinin | 1,041 bp linear mRNA | Z46403.1 GI: 609043 |
| 59. Influenza A virus (A/England/68/1994(H3N2)) mRNA for haemagglutinin | 1,041 bp linear mRNA | Z46404.1 GI: 609045 |
| 60. Influenza A virus (A/England/7/1994(H3N2)) mRNA for haemagglutinin | 1,041 bp linear mRNA | Z46405.1 GI: 609047 |

TABLE 8-continued

| Influenza H3N2 Antigens | | |
|---|---|---|
| Strain/Protein | Length | GenBank/GI Accession No. |
| 63. Influenza A virus (A/Guandong/28/1994(H3N2)) haemagglutinin mRNA, partial cds | 1,032 bp linear mRNA | U48442.1 GI: 1574985 |
| 64. Influenza A virus (A/Guangdong/25/1993(H3N2)) mRNA for haemagglutinin | 1,041 bp linear mRNA | Z46406.1 GI: 609049 |
| 65. Influenza A virus (A/Hebei/19/1995(H3N2)) haemagglutinin mRNA, partial cds | 1,032 bp linear mRNA | U48447.1 GI: 1574995 |
| 66. Influenza A virus (A/Hebei/41/1994(H3N2)) haemagglutinin mRNA, partial cds | 1,032 bp linear mRNA | U48441.1 GI: 1574983 |
| 67. Influenza A virus (A/Hong Kong/1/68(H3N2)) hemagglutinin mRNA, partial cds | 1,091 bp linear mRNA | AF201874.1 GI: 6470272 |
| 68. Influenza A virus (A/Hong Kong/1/1994(H3N2)) mRNA for haemagglutinin | 1,041 bp linear mRNA | Z46407.1 GI: 609051 |
| 69. Influenza A virus (A/Hong Kong/1143/99(H3N2)) hemagglutinin mRNA, complete cds | 1,762 bp linear mRNA | AY035588.1 GI: 14486401 |
| 70. Influenza A virus (A/Hong Kong/1143/99(H3N2)) hemagglutinin mRNA, complete cds | 1,762 bp linear mRNA | AF382319.1 GI: 14487957 |
| 71. Influenza A virus (A/Hong Kong/1143/99(H3N2)) hemagglutinin mRNA, complete cds | 1,762 bp linear mRNA | AF382320.1 GI: 14487959 |
| 72. Influenza A virus (A/Hong Kong/1143/99(H3N2)) neuraminidase mRNA, complete cds | 1,466 bp linear mRNA | AF382329.1 GI: 14487977 |
| 73. Influenza A virus (A/Hong Kong/1143/99(H3N2)) neuraminidase mRNA, complete cds | 1,466 bp linear mRNA | AF382330.1 GI: 14487979 |
| 74. Influenza A virus (A/Hong Kong/1144/99(H3N2)) hemagglutinin mRNA, complete cds | 1,762 bp linear mRNA | AY035589.1 GI: 14486403 |
| 75. Influenza A virus (A/Hong Kong/1144/99(H3N2)) hemagglutinin mRNA, complete cds | 1,762 bp linear mRNA | AF382321.1 GI: 14487961 |
| 76. Influenza A virus (A/Hong Kong/1144/99(H3N2)) hemagglutinin mRNA, complete cds | 1,762 bp linear mRNA | AF382322.1 GI: 14487963 |
| 77. Influenza A virus (A/Hong Kong/1144/99(H3N2)) neuraminidase mRNA, complete cds | 1,466 bp linear mRNA | AF382331.1 GI: 14487981 |
| 78. Influenza A virus (A/Hong Kong/1144/99(H3N2)) neuraminidase mRNA, complete cds | 1,466 bp linear mRNA | AF382332.1 GI: 14487983 |
| 79. Influenza A virus (A/Hong Kong/1179/99(H3N2)) hemagglutinin mRNA, complete cds | 1,762 bp linear mRNA | AY035590.1 GI: 14486405 |
| 80. Influenza A virus (A/Hong Kong/1179/99(H3N2)) hemagglutinin mRNA, complete cds | 1,762 bp linear mRNA | AF382323.1 GI: 14487965 |
| 81. Influenza A virus (A/Hong Kong/1179/99(H3N2)) hemagglutinin mRNA, complete cds | 1,762 bp linear mRNA | AF382324.1 GI: 14487967 |
| 82. Influenza A virus (A/Hong Kong/1180/99(H3N2)) hemagglutinin mRNA, complete cds | 1,762 bp linear mRNA | AY035591.1 GI: 14486407 |
| 83. Influenza A virus (A/Hong Kong/1180/99(H3N2)) hemagglutinin mRNA, complete cds | 1,762 bp linear mRNA | AF382325.1 GI: 14487969 |
| 84. Influenza A virus (A/Hong Kong/1180/99(H3N2)) hemagglutinin mRNA, complete cds | 1,762 bp linear mRNA | AF382326.1 GI: 14487971 |
| 85. Influenza A virus (A/Hong Kong/1182/99(H3N2)) hemagglutinin mRNA, complete cds | 1,762 bp linear mRNA | AY035592.1 GI: 14486409 |
| 86. Influenza A virus (A/Hong Kong/1182/99(H3N2)) hemagglutinin mRNA, complete cds | 1,762 bp linear mRNA | AF382327.1 GI: 14487973 |
| 87. Influenza A virus (A/Hong Kong/1182/99(H3N2)) hemagglutinin mRNA, complete cds | 1,762 bp linear mRNA | AF382328.1 GI: 14487975 |

TABLE 8-continued

| Influenza H3N2 Antigens | | |
|---|---|---|
| Strain/Protein | Length | GenBank/GI Accession No. |
| 88. Influenza A virus (A/Hong Kong/2/1994(H3N2)) mRNA for haemagglutinin | 1,041 bp linear mRNA | Z46408.1 GI: 609055 |
| 89. Influenza A virus (A/Hong Kong/23/1992(H3N2)) mRNA for haemagglutinin | 1,041 bp linear mRNA | Z46410.1 GI: 609053 |
| 90. Influenza A virus (A/Hong Kong/34/1990(H3N2)) mRNA for haemagglutinin | 1,041 bp linear mRNA | Z46409.1 GI: 609057 |
| 91. Influenza A virus (A/Indiana/28170/99(H3N2)) hemagglutinin (HA) mRNA, partial cds | 987 bp linear mRNA | AF501534.1 GI: 21314324 |
| 92. Influenza A virus (A/Kinmen/618/03(H3N2)) hemagglutinin (HA) mRNA, partial cds | 529 bp linear mRNA | AY961997.1 GI: 68138151 |
| 93. Influenza A virus (A/Kinmen/618/03(H3N2)) neuraminidase (NA) mRNA, partial cds | 383 bp linear mRNA | AY973325.1 GI: 70673206 |
| 94. Influenza A virus (A/Kinmen/618/03(H3N2)) nucleoprotein (NP) mRNA, partial cds | 882 bp linear mRNA | AY986986.1 GI: 70728099 |
| 95. Influenza A virus (A/Kinmen/621/03(H3N2)) hemagglutinin (HA) mRNA, partial cds | 545 bp linear mRNA | AY962017.1 GI: 68138191 |
| 96. Influenza A virus (A/Kinmen/621/03(H3N2)) neuraminidase (NA) mRNA, partial cds | 386 bp linear mRNA | AY973326.1 GI: 70673208 |
| 97. Influenza A virus (A/Kinmen/621/03(H3N2)) nucleoprotein (NP) mRNA, partial cds | 882 bp linear mRNA | AY986987.1 GI: 70728101 |
| 98. Influenza A virus (A/Kinmen/639/04(H3N2)) hemagglutinin (HA) mRNA, partial cds | 786 bp linear mRNA | AY962008.1 GI: 68138173 |
| 99. Influenza A virus (A/Kinmen/639/04(H3N2)) neuraminidase (NA) mRNA, partial cds | 381 bp linear mRNA | AY973327.1 GI: 70673210 |
| 100. Influenza A virus (A/Kinmen/639/04(H3N2)) nucleoprotein (NP) mRNA, partial cds | 882 bp linear mRNA | AY986988.1 GI: 70728103 |
| 101. Influenza A virus (A/Kinmen/641/04(H3N2)) hemagglutinin (HA) mRNA, partial cds | 596 bp linear mRNA | AY962004.1 GI: 68138165 |
| 102. Influenza A virus (A/Kinmen/641/04(H3N2)) neuraminidase (NA) mRNA, partial cds | 785 bp linear mRNA | AY973328.1 GI: 70673212 |
| 103. Influenza A virus (A/Kinmen/642/04(H3N2)) hemagglutinin (HA) mRNA, partial cds | 576 bp linear mRNA | AY962001.1 GI: 68138159 |
| 104. Influenza A virus (A/Kinmen/642/04(H3N2)) neuraminidase (NA) mRNA, partial cds | 580 bp linear mRNA | AY973329.1 GI: 70673214 |
| 105. Influenza A virus (A/Kinmen/642/04(H3N2)) nucleoprotein (NP) mRNA, partial cds | 882 bp linear mRNA | AY986989.1 GI: 70728105 |
| 106. Influenza A virus (A/Kinmen/645/04(H3N2)) hemagglutinin (HA) mRNA, partial cds | 789 bp linear mRNA | AY962009.1 GI: 68138175 |
| 107. Influenza A virus (A/Kinmen/645/04(H3N2)) neuraminidase (NA) mRNA, partial cds | 581 bp linear mRNA | AY973330.1 GI: 70673216 |
| 108. Influenza A virus (A/Kinmen/645/04(H3N2)) nucleoprotein (NP) mRNA, partial cds | 981 bp linear mRNA | AY986990.1 GI: 70728107 |
| 109. Influenza A virus (A/LosAngeles/2/1987(H3N2)) polymerase protein basic 2 (PB2) mRNA, complete cds | 2,341 bp linear mRNA | U62543.1 GI: 1480737 |
| 110. Influenza A virus (A/Madrid/252/1993(H3N2)) mRNA for haemagglutinin | 1,041 bp linear mRNA | Z46411.1 GI: 609067 |
| 111. Influenza A virus (A/Michigan/22568/99(H3N2)) hemagglutinin (HA) mRNA, partial cds | 987 bp linear mRNA | AF501531.1 GI: 21314318 |
| 112. Influenza A virus (A/Michigan/22692/99(H3N2)) hemagglutinin (HA) mRNA, partial cds | 987 bp linear mRNA | AF501518.1 GI: 21314292 |
| 113. Influenza A virus (A/Moscow/10/99(H3N2)) partial NS1 gene for non structural protein 1 and partial NS2 | 754 bp linear mRNA | AJ519454.1 GI: 31096423 |

TABLE 8-continued

| Influenza H3N2 Antigens | | |
|---|---|---|
| Strain/Protein | Length | GenBank/GI Accession No. |
| gene for non structural protein 2, genomic RNA | | |
| 114. Influenza A virus (A/ningbo/17/2002(H3N2)) hemagglutinin (HA) mRNA, partial cds | 987 bp linear mRNA | AY138518.1 GI: 24895178 |
| 115. Influenza A virus (A/ningbo/25/2002(H3N2)) hemagglutinin (HA) mRNA, partial cds | 987 bp linear mRNA | AY138517.1 GI: 24895169 |
| 116. Influenza A virus (A/NT/60/68/29C(H3N2)) mRNA for haemagglutinin (HA1 and HA2 genes) | 1,765 bp linear mRNA | V01103.1 GI: 60800 |
| 117. Influenza A virus (A/Oklahoma/323/03(H3N2)) hemagglutinin mRNA, complete cds | 1,701 bp linear mRNA | DQ059385.1 GI: 66933143 |
| 118. Influenza A virus (A/Oklahoma/323/03(H3N2)) neuraminidase mRNA, complete cds | 1,410 bp linear mRNA | DQ059384.2 GI: 75859981 |
| 119. Influenza A virus (A/Panama/2007/99(H3N2)) partial NS1 gene for non structural protein 1 and partial NS2 gene for non structural protein 2, genomic RNA | 766 bp linear mRNA | AJ519458.1 GI: 31096435 |
| 120. Influenza A virus (A/Pennsylvania/20109/99(H3N2)) hemagglutinin (HA) mRNA, partial cds | 987 bp linear mRNA | AF501526.1 GI: 21314308 |
| 121. Influenza A virus (A/Philippines/2/82(H3N2)) hemagglutinin mRNA, partial cds | 1,091 bp linear mRNA | AF233691.1 GI: 7331124 |
| 122. Influenza A virus (A/Pingtung/303/04(H3N2)) hemagglutinin (HA) mRNA, partial cds | 767 bp linear mRNA | AY962000.1 GI: 68138157 |
| 123. Influenza A virus (A/Pingtung/303/04(H3N2)) neuraminidase (NA) mRNA, partial cds | 783 bp linear mRNA | AY973331.1 GI: 70673218 |
| 124. Influenza A virus (A/Pingtung/303/04(H3N2)) nucleoprotein (NP) mRNA, partial cds | 928 bp linear mRNA | AY986991.1 GI: 70728109 |
| 125. Influenza A virus (A/Pingtung/313/04(H3N2)) hemagglutinin (HA) mRNA, partial cds | 788 bp linear mRNA | AY961999.1 GI: 68138155 |
| 126. Influenza A virus (A/Pingtung/313/04(H3N2)) neuraminidase (NA) mRNA, partial cds | 787 bp linear mRNA | AY973332.1 GI: 70673220 |
| 127. Influenza A virus (A/Pingtung/313/04(H3N2)) nucleoprotein (NP) mRNA, partial cds | 882 bp linear mRNA | AY986992.1 GI: 70728111 |
| 128. Influenza A virus (A/ruddy turnstone/Delaware/142/99 (H3N2)) nonfunctional matrix protein mRNA, partial sequence | 927 bp linear mRNA | AY664458.1 GI: 51011862 |
| 129. Influenza A virus (A/Scotland/142/1993(H3N2)) mRNA for haemagglutinin | 1,041 bp linear mRNA | Z46413.1 GI: 609059 |
| 130. Influenza A virus (A/Scotland/160/1993(H3N2)) mRNA for haemagglutinin | 1,041 bp linear mRNA | Z46414.1 GI: 609061 |
| 131. Influenza A virus (A/Scotland/173/1993(H3N2)) mRNA for haemagglutinin | 1,041 bp linear mRNA | Z46416.1 GI: 609063 |
| 132. Influenza A virus (A/Scotland/174/1993(H3N2)) mRNA for haemagglutinin | 1,041 bp linear mRNA | Z46415.1 GI: 609065 |
| 133. Influenza A virus (A/Scotland/2/1993(H3N2)) mRNA for haemagglutinin | 1,041 bp linear mRNA | Z46412.1 GI: 609069 |
| 134. Influenza A virus (A/Sendai/C182/1994(H3N2)) haemagglutinin mRNA, partial cds | 1,032 bp linear mRNA | U48439.1 GI: 1574979 |
| 135. Influenza A virus (A/Sendai/c373/1995(H3N2)) haemagglutinin mRNA, partial cds | 1,032 bp linear mRNA | U48445.1 GI: 1574991 |
| 136. Influenza A virus (A/Sendai/c384/1994(H3N2)) haemagglutinin mRNA, partial cds | 1,032 bp linear mRNA | U48440.1 GI: 1574981 |

TABLE 8-continued

| Influenza H3N2 Antigens | | |
|---|---|---|
| Strain/Protein | Length | GenBank/GI Accession No. |
| 137. Influenza A virus (A/Shangdong/9/1993(H3N2)) mRNA for haemagglutinin | 1,041 bp linear mRNA | Z46417.1 GI: 609071 |
| 138. Influenza A virus (A/Shanghai/11/1987/X99aE high yield reassortant(H3N2)) hemagglutinin (HA) mRNA, partial cds | 987 bp linear mRNA | L19416.1 GI: 348117 |
| 139. Influenza A virus (A/sw/Shizuoka/110/97(H3N2)) polymerase basic 2 (PB2) mRNA, complete cds | 2,280 bp linear mRNA | AF225514.1 GI: 27462098 |
| 140. Influenza A virus (A/sw/Shizuoka/110/97(H3N2)) polymerase basic 1 (PB1) mRNA, complete cds | 2,274 bp linear mRNA | AF225518.1 GI: 27462106 |
| 141. Influenza A virus (A/sw/Shizuoka/110/97(H3N2)) polymerase acidic (PA) mRNA, complete cds | 2,151 bp linear mRNA | AF225522.1 GI: 27462114 |
| 142. Influenza A virus (A/sw/Shizuoka/110/97(H3N2)) nucleoprotein (NP) mRNA, complete cds | 1,497 bp linear mRNA | AF225534.1 GI: 27462146 |
| 143. Influenza A virus (A/sw/Shizuoka/110/97(H3N2)) neuraminidase (NA) mRNA, complete cds | 1,410 bp linear mRNA | AF225538.1 GI: 27462154 |
| 144. Influenza A virus (A/sw/Shizuoka/110/97(H3N2)) hemagglutinin (HA1) mRNA, partial cds | 984 bp linear mRNA | AF225542.1 GI: 27462162 |
| 145. Influenza A virus (A/sw/Shizuoka/115/97(H3N2)) polymerase basic 2 (PB2) mRNA, complete cds | 2,280 bp linear mRNA | AF225515.1 GI: 27462100 |
| 146. Influenza A virus (A/sw/Shizuoka/115/97(H3N2)) polymerase basic 1 (PB1) mRNA, complete cds | 2,274 bp linear mRNA | AF225519.1 GI: 27462108 |
| 147. Influenza A virus (A/sw/Shizuoka/115/97(H3N2)) polymerase acidic (PA) mRNA, complete cds | 2,151 bp linear mRNA | AF225523.1 GI: 27462116 |
| 148. Influenza A virus (A/sw/Shizuoka/115/97(H3N2)) nucleoprotein (NP) mRNA, complete cds | 1,497 bp linear mRNA | AF225535.1 GI: 27462148 |
| 149. Influenza A virus (A/sw/Shizuoka/115/97(H3N2)) neuraminidase (NA) mRNA, complete cds | 1,410 bp linear mRNA | AF225539.1 GI: 27462156 |
| 150. Influenza A virus (A/sw/Shizuoka/115/97(H3N2)) hemagglutinin (HA1) mRNA, partial cds | 984 bp linear mRNA | AF225543.1 GI: 27462164 |
| 151. Influenza A virus (A/sw/Shizuoka/119/97(H3N2)) polymerase basic 2 (PB2) mRNA, complete cds | 2,280 bp linear mRNA | AF225516.1 GI: 27462102 |
| 152. Influenza A virus (A/sw/Shizuoka/119/97(H3N2)) polymerase basic 1 (PB1) mRNA, complete cds | 2,274 bp linear mRNA | AF225520.1 GI: 27462110 |
| 153. Influenza A virus (A/sw/Shizuoka/119/97(H3N2)) polymerase acidic (PA) mRNA, complete cds | 2,151 bp linear mRNA | AF225524.1 GI: 27462118 |
| 154. Influenza A virus (A/sw/Shizuoka/119/97(H3N2)) nucleoprotein (NP) mRNA, complete cds | 1,497 bp linear mRNA | AF225536.1 GI: 27462150 |
| 155. Influenza A virus (A/sw/Shizuoka/119/97(H3N2)) neuraminidase (NA) mRNA, complete cds | 1,410 bp linear mRNA | AF225540.1 GI: 27462158 |
| 156. Influenza A virus (A/sw/Shizuoka/119/97(H3N2)) hemagglutinin (HA1) mRNA, partial cds | 984 bp linear mRNA | AF225544.1 GI: 27462166 |
| 159. Influenza A virus (A/swine/Bakum/1DTI769/2003(H3N2)) neuraminidase mRNA, complete cds | 1,410 bp linear mRNA | EU163948.1 GI: 157679552 |
| 163. Influenza A virus (A/swine/Fujian/668/01(H3N2)) nonfunctional hemagglutinin mRNA, complete sequence | 1,738 bp linear mRNA | AY857957.1 GI: 58042507 |
| 164. Influenza A virus PB2 gene for Polymerase 2 protein, genomic RNA, strain A/Swine/Italy/1523/98 | 2,280 bp linear mRNA | AJ311459.1 GI: 13661041 |
| 165. Influenza A virus PB1 gene for Polymerase 1 protein, genomic RNA, strain A/Swine/Italy/1523/98 | 2,274 bp linear mRNA | AJ311460.1 GI: 13661043 |
| 166. Influenza A virus (A/swine/Italy/1523/98(H3N2)) NS1 gene for | 821 bp linear mRNA | AJ344024.1 GI: 20068146 |

TABLE 8-continued

Influenza H3N2 Antigens

| Strain/Protein | Length | GenBank/GI Accession No. |
|---|---|---|
| non structural protein 1 and NS2 gene for non structural protein 2, genomic RNA | | |
| 167. Influenza A virus (A/swine/Re220/92hp(H3N2)) neuraminidase mRNA, complete cds | 1,465 bp linear mRNA | EU163949.1 GI: 157679554 |
| 168. Influenza A virus (A/sw/Shizuoka/120/97(H3N2)) polymerase basic 2 (PB2) mRNA, complete cds | 2,280 bp linear mRNA | AF225517.1 GI: 27462104 |
| 169. Influenza A virus (A/sw/Shizuoka/120/97(H3N2)) polymerase basic 1 (PB1) mRNA, complete cds | 2,274 bp linear mRNA | AF225521.1 GI: 27462112 |
| 170. Influenza A virus (A/sw/Shizuoka/120/97(H3N2)) polymerase acidic (PA) mRNA, complete cds | 2,151 bp linear mRNA | AF225525.1 GI: 27462120 |
| 171. Influenza A virus (A/sw/Shizuoka/120/97(H3N2)) nucleoprotein (NP) mRNA, complete cds | 1,497 bp linear mRNA | AF225537.1 GI: 27462152 |
| 172. Influenza A virus (A/sw/Shizuoka/120/97(H3N2)) neuraminidase (NA) mRNA, complete cds | 1,410 bp linear mRNA | AF225541.1 GI: 27462160 |
| 173. Influenza A virus (A/sw/Shizuoka/120/97(H3N2)) hemagglutinin (HA1) mRNA, partial cds | 984 bp linear mRNA | AF225545.1 GI: 27462168 |
| 174. Influenza A virus (A/Switzerland/7729/98(H3N2)) hemagglutinin mRNA, complete cds | 1,762 bp linear mRNA | AY032978.1 GI: 14161723 |
| 175. Influenza A virus (A/Switzerland/7729/98(H3N2)) hemagglutinin mRNA, complete cds | 1,762 bp linear mRNA | AF382318.1 GI: 14487955 |
| 176. Influenza A virus (A/Tainan/704/03(H3N2)) hemagglutinin (HA) mRNA, partial cds | 528 bp linear mRNA | AY962011.1 GI: 68138179 |
| 177. Influenza A virus (A/Tainan/704/03(H3N2)) neuraminidase (NA) mRNA, partial cds | 384 bp linear mRNA | AY973333.1 GI: 70673222 |
| 178. Influenza A virus (A/Tainan/704/03(H3N2)) nucleoprotein (NP) mRNA, partial cds | 882 bp linear mRNA | AY986993.1 GI: 70728113 |
| 179. Influenza A virus (A/Tainan/712/03(H3N2)) hemagglutinin (HA) mRNA, partial cds | 519 bp linear mRNA | AY962012.1 GI: 68138181 |
| 180. Influenza A virus (A/Tainan/712/03(H3N2)) neuraminidase (NA) mRNA, partial cds | 383 bp linear mRNA | AY973334.1 GI: 70673224 |
| 181. Influenza A virus (A/Tainan/712/03(H3N2)) nucleoprotein (NP) mRNA, partial cds | 882 bp linear mRNA | AY986994.1 GI: 70728115 |
| 182. Influenza A virus (A/Tainan/722/03(H3N2)) hemagglutinin (HA) mRNA, partial cds | 784 bp linear mRNA | AY962005.1 GI: 68138167 |
| 183. Influenza A virus (A/Tainan/722/03(H3N2)) neuraminidase (NA) mRNA, partial cds | 592 bp linear mRNA | AY973335.1 GI: 70673226 |
| 184. Influenza A virus (A/Tainan/722/03(H3N2)) nucleoprotein (NP) mRNA, partial cds | 936 bp linear mRNA | AY986995.1 GI: 70728117 |
| 185. Influenza A virus (A/Taipei/407/03(H3N2)) hemagglutinin (HA) mRNA, partial cds | 788 bp linear mRNA | AY961998.1 GI: 68138153 |
| 186. Influenza A virus (A/Taipei/407/03(H3N2)) neuraminidase (NA) mRNA, partial cds | 787 bp linear mRNA | AY973336.1 GI: 70673228 |
| 187. Influenza A virus (A/Taipei/407/03(H3N2)) nucleoprotein (NP) mRNA, partial cds | 882 bp linear mRNA | AY986996.1 GI: 70728119 |
| 188. Influenza A virus (A/Taipei/416/03(H3N2)) hemagglutinin (HA) mRNA, partial cds | 787 bp linear mRNA | AY962007.1 GI: 68138171 |
| 189. Influenza A virus (A/Taipei/416/03(H3N2)) neuraminidase (NA) mRNA, partial cds | 782 bp linear mRNA | AY973337.1 GI: 70673230 |
| 190. Influenza A virus (A/Taipei/416/03(H3N2)) nucleoprotein (NP) mRNA, partial cds | 882 bp linear mRNA | AY986997.1 GI: 70728121 |

TABLE 8-continued

| Influenza H3N2 Antigens | | |
|---|---|---|
| Strain/Protein | Length | GenBank/GI Accession No. |
| 191. Influenza A virus (A/Taiwan/0020/98 (H3N2)) polymerase basic protein 1 (PB1) mRNA, partial cds | 297 bp linear mRNA | AY303703.1 GI: 32330895 |
| 192. Influenza A virus (A/Taiwan/0040/2003(H3N2)) hemagglutinin mRNA, partial cds | 791 bp linear mRNA | AY604817.1 GI: 50727514 |
| 193. Influenza A virus (A/Taiwan/0045/98 (H3N2)) polymerase basic protein 1 (PB1) mRNA, partial cds | 297 bp linear mRNA | AY303705.1 GI: 32330899 |
| 194. Influenza A virus (A/human/Taiwan/0095/96(H3N2)) hemagglutinin (HA) mRNA, partial cds | 844 bp linear mRNA | AF362820.1 GI: 15055140 |
| 195. Influenza A virus (A/Taiwan/0097/2003(H3N2)) hemagglutinin mRNA, partial cds | 791 bp linear mRNA | AY604828.1 GI: 50727536 |
| 196. Influenza A virus (A/Taiwan/0104/2001 (H3N2)) polymerase basic protein 1 (PB1) mRNA, partial cds | 297 bp linear mRNA | AY303706.1 GI: 32330901 |
| 197. Influenza A virus (A/human/Taiwan/0118/98(H3N2)) hemagglutinin (HA) mRNA, partial cds | 844 bp linear mRNA | AF362805.1 GI: 15055110 |
| 198. Influenza A virus (A/Taiwan/0122/2003(H3N2)) hemagglutinin mRNA, partial cds | 791 bp linear mRNA | AY604823.1 GI: 50727526 |
| 199. Influenza A virus (A/human/Taiwan/0149/00(H3N2)) hemagglutinin (HA) mRNA, partial cds | 844 bp linear mRNA | AF362806.1 GI: 15055112 |
| 200. Influenza A virus (A/Taiwan/0275/2000 (H3N2)) polymerase basic protein 1 (PB1) mRNA, partial cds | 297 bp linear mRNA | AY303712.1 GI: 32330913 |
| 201. Influenza A virus (A/Taiwan/0275/2000 (H3N2)) hemagglutinin (HA) mRNA, partial cds | 844 bp linear mRNA | AY303713.1 GI: 32330915 |
| 202. Influenza A virus (A/human/Taiwan/0293/98(H3N2)) hemagglutinin (HA) mRNA, partial cds | 844 bp linear mRNA | AF362807.1 GI: 15055114 |
| 203. Influenza A virus (A/Taiwan/0346/98 (H3N2)) polymerase basic protein 1 (PB1) mRNA, partial cds | 297 bp linear mRNA | AY303715.1 GI: 32330919 |
| 204. Influenza A virus (A/Taiwan/0379/2000 (H3N2)) polymerase basic protein 1 (PB1) mRNA, partial cds | 297 bp linear mRNA | AY303716.1 GI: 32330921 |
| 205. Influenza A virus (A/Taiwan/0379/2000 (H3N2)) hemagglutinin (HA) mRNA, partial cds | 844 bp linear mRNA | AY303717.1 GI: 32330923 |
| 206. Influenza A virus (A/Taiwan/0388/2001(H3N2)) hemagglutinin (HA) mRNA, partial cds | 791 bp linear mRNA | AY625729.1 GI: 50604415 |
| 207. Influenza A virus (A/human/Taiwan/0389/99(H3N2)) hemagglutinin (HA) mRNA, partial cds | 844 bp linear mRNA | AF362808.1 GI: 15055116 |
| 208. Influenza A virus (A/human/Taiwan/0423/98(H3N2)) hemagglutinin (HA) mRNA, partial cds | 844 bp linear mRNA | AF362809.1 GI: 15055118 |
| 209. Influenza A virus (A/Taiwan/0423/98 (H3N2)) polymerase basic protein 1 (PB1) mRNA, partial cds | 297 bp linear mRNA | AY303718.1 GI: 32330925 |
| 210. Influenza A virus (A/human/Taiwan/0464/98(H3N2)) hemagglutinin (HA) mRNA, partial cds | 844 bp linear mRNA | AF362810.1 GI: 15055120 |
| 211. Influenza A virus (A/Taiwan/0464/98 (H3N2)) polymerase basic protein 1 (PB1) mRNA, partial cds | 297 bp linear mRNA | AY303719.1 GI: 32330927 |
| 212. Influenza A virus (A/Taiwan/0568/2001(H3N2)) hemagglutinin (HA) mRNA, partial cds | 791 bp linear mRNA | AY625730.1 GI: 50604440 |
| 213. Influenza A virus (A/Taiwan/0570/2003(H3N2)) hemagglutinin mRNA, partial cds | 791 bp linear mRNA | AY604822.1 GI: 50727524 |
| 214. Influenza A virus (A/Taiwan/0572/2003(H3N2)) hemagglutinin mRNA, partial cds | 791 bp linear mRNA | AY604827.1 GI: 50727534 |
| 215. Influenza A virus (A/Taiwan/0578/2003(H3N2)) hemagglutinin mRNA, partial cds | 791 bp linear mRNA | AY604821.1 GI: 50727522 |

TABLE 8-continued

| Influenza H3N2 Antigens | | |
|---|---|---|
| Strain/Protein | Length | GenBank/GI Accession No. |
| 216. Influenza A virus (A/Taiwan/0583/2003(H3N2)) hemagglutinin mRNA, partial cds | 791 bp linear mRNA | AY604820.1 GI: 50727520 |
| 217. Influenza A virus (A/Taiwan/0646/2000 (H3N2)) polymerase basic protein 1 (PB1) mRNA, partial cds | 297 bp linear mRNA | AY303722.1 GI: 32330933 |
| 218. Influenza A virus (A/Taiwan/0646/2000 (H3N2)) hemagglutinin (HA) mRNA, partial cds | 844 bp linear mRNA | AY303723.1 GI: 32330935 |
| 219. Influenza A virus (A/human/Taiwan/0830/99(H3N2)) hemagglutinin (HA) mRNA, partial cds | 844 bp linear mRNA | AF362811.1 GI: 15055122 |
| 220. Influenza A virus (A/Taiwan/0964/2001(H3N2)) hemagglutinin (HA) mRNA, partial cds | 791 bp linear mRNA | AY625731.1 GI: 50604469 |
| 221. Influenza A virus (A/human/Taiwan/1008/99(H3N2)) hemagglutinin (HA) mRNA, partial cds | 844 bp linear mRNA | AF362812.1 GI: 15055124 |
| 222. Influenza A virus (A/Taiwan/1008/99 (H3N2)) polymerase basic protein 1 (PB1) mRNA, partial cds | 297 bp linear mRNA | AY303725.1 GI: 32330939 |
| 223. Influenza A virus (A/Taiwan/1219/2004(H3N2)) hemagglutinin (HA) mRNA, partial cds | 750 bp linear mRNA | EU068138.1 GI: 158452149 |
| 224. Influenza A virus (A/Taiwan/1315/2005(H3N2)) hemagglutinin (HA) mRNA, partial cds | 750 bp linear mRNA | EU068125.1 GI: 158452123 |
| 225. Influenza A virus (A/Taiwan/1511/2004(H3N2)) hemagglutinin (HA) mRNA, partial cds | 750 bp linear mRNA | EU068153.1 GI: 158452179 |
| 226. Influenza A virus (A/Taiwan/1533/2003(H3N2)) hemagglutinin (HA) mRNA, partial cds | 750 bp linear mRNA | EU068119.1 GI: 158452111 |
| 227. Influenza A virus (A/human/Taiwan/1537/99(H3N2)) hemagglutinin (HA) mRNA, partial cds | 844 bp linear mRNA | AF362813.1 GI: 15055126 |
| 228. Influenza A virus (A/Taiwan/1537/99 (H3N2)) polymerase basic protein 1 (PB1) mRNA, partial cds | 297 bp linear mRNA | AY303728.1 GI: 32330945 |
| 229. Influenza A virus (A/Taiwan/1566/2003(H3N2)) hemagglutinin mRNA, partial cds | 791 bp linear mRNA | AY604826.1 GI: 50727532 |
| 230. Influenza A virus (A/Taiwan/1568/2003(H3N2)) hemagglutinin mRNA, partial cds | 791 bp linear mRNA | AY604819.1 GI: 50727518 |
| 231. Influenza A virus (A/Taiwan/158/2003(H3N2)) hemagglutinin (HA) mRNA, partial cds | 750 bp linear mRNA | EU068116.1 GI: 158452105 |
| 232. Influenza A virus (A/Taiwan/1600/96(H3N2)) matrix protein M1 (M) mRNA, partial cds | 875 bp linear mRNA | AF138709.2 GI: 4996869 |
| 233. Influenza A virus (A/Taiwan/1613/2003(H3N2)) hemagglutinin (HA) mRNA, partial cds | 750 bp linear mRNA | EU068117.1 GI: 158452107 |
| 234. Influenza A virus (A/Taiwan/1651/2004(H3N2)) hemagglutinin (HA) mRNA, partial cds | 750 bp linear mRNA | EU068148.1 GI: 158452169 |
| 235. Influenza A virus (A/human/Taiwan/1748/97(H3N2)) hemagglutinin (HA) mRNA, partial cds | 844 bp linear mRNA | AF362814.1 GI: 15055128 |
| 236. Influenza A virus (A/Taiwan/1748/97 (H3N2)) polymerase basic protein 1 (PB1) mRNA, partial cds | 297 bp linear mRNA | AY303729.1 GI: 32330947 |
| 237. Influenza A virus (A/Taiwan/179/96(H3N2)) matrix protein M1 (M) mRNA, partial cds | 872 bp linear mRNA | AF138707.2 GI: 4996865 |
| 238. Influenza A virus (A/Taiwan/1817/2004(H3N2)) hemagglutinin (HA) mRNA, partial cds | 750 bp linear mRNA | EU068139.1 GI: 158452151 |
| 239. Influenza A virus (A/Taiwan/1904/2003(H3N2)) hemagglutinin (HA) mRNA, partial cds | 750 bp linear mRNA | EU068154.1 GI: 158452181 |
| 240. Influenza A virus (A/Taiwan/1921/2003(H3N2)) hemagglutinin (HA) mRNA, partial cds | 750 bp linear mRNA | EU068155.1 GI: 158452183 |

TABLE 8-continued

| Influenza H3N2 Antigens | | |
|---|---|---|
| Strain/Protein | Length | GenBank/GI Accession No. |
| 241. Influenza A virus (A/human/Taiwan/1986/96(H3N2)) hemagglutinin (HA) mRNA, partial cds | 844 bp linear mRNA | AF362815.1 GI: 15055130 |
| 242. Influenza A virus (A/Taiwan/1990/96 (H3N2)) polymerase basic protein 1 (PB1) mRNA, partial cds | 297 bp linear mRNA | AY303730.1 GI: 32330949 |
| 243. Influenza A virus (A/Taiwan/1990/96 (H3N2)) hemagglutinin (HA) mRNA, partial cds | 844 bp linear mRNA | AY303731.1 GI: 32330951 |
| 244. Influenza A virus (A/Taiwan/20/98(H3N2)) H3 hemagglutinin (HA) mRNA, partial cds | 861 bp linear mRNA | AF139938.1 GI: 4972940 |
| 245. Influenza A virus (A/Taiwan/20/98(H3N2)) N2 neuraminidase (NA) mRNA, partial cds | 392 bp linear mRNA | AF140627.1 GI: 4972988 |
| 246. Influenza A virus (A/Taiwan/20/98(H3N2)) matrix protein M1 (M) mRNA, partial cds | 875 bp linear mRNA | AF138715.2 GI: 4996879 |
| 247. Influenza A virus (A/human/Taiwan/2031/97(H3N2)) hemagglutinin (HA) mRNA, partial cds | 844 bp linear mRNA | AF362816.1 GI: 15055132 |
| 248. Influenza A virus (A/Taiwan/2034/96(H3N2)) H3 hemagglutinin (HA) mRNA, partial cds | 861 bp linear mRNA | AF139937.1 GI: 4972938 |
| 249. Influenza A virus (A/Taiwan/2034/96(H3N2)) N2 neuraminidase (NA) mRNA, partial cds | 392 bp linear mRNA | AF140620.1 GI: 4972974 |
| 250. Influenza A virus (A/Taiwan/2034/96(H3N2)) polymerase basic protein 1 (PB1) mRNA, partial cds | 297 bp linear mRNA | AY303732.1 GI: 32330953 |
| 251. Influenza A virus (A/Taiwan/2040/2003(H3N2)) hemagglutinin mRNA, partial cds | 791 bp linear mRNA | AY604818.1 GI: 50727516 |
| 252. Influenza A virus (A/Taiwan/2072/2006(H3N2)) hemagglutinin (HA) mRNA, partial cds | 750 bp linear mRNA | EU068131.1 GI: 158452135 |
| 253. Influenza A virus (A/Taiwan/21/98(H3N2)) H3 hemagglutinin (HA) mRNA, partial cds | 861 bp linear mRNA | AF139934.1 GI: 4972932 |
| 254. Influenza A virus (A/Taiwan/21/98(H3N2)) N2 neuraminidase (NA) mRNA, partial cds | 392 bp linear mRNA | AF140624.1 GI: 4972982 |
| 255. Influenza A virus (A/Taiwan/21/98(H3N2)) matrix protein M1 (M) mRNA, partial cds | 875 bp linear mRNA | AF138716.2 GI: 4996881 |
| 256. Influenza A virus (A/Taiwan/2191/96(H3N2)) H3 hemagglutinin (HA) mRNA, partial cds | 861 bp linear mRNA | AF139932.1 GI: 4972928 |
| 257. Influenza A virus (A/Taiwan/2191/96(H3N2)) N2 neuraminidase (NA) mRNA, partial cds | 392 bp linear mRNA | AF140622.1 GI: 4972978 |
| 258. Influenza A virus (A/Taiwan/2191/96(H3N2)) matrix protein M1 (M) mRNA, partial cds | 875 bp linear mRNA | AF138711.3 GI: 156147502 |
| 259. Influenza A virus (A/Taiwan/2192/96(H3N2)) H3 hemagglutinin (HA) mRNA, partial cds | 861 bp linear mRNA | AF139936.1 GI: 4972936 |
| 260. Influenza A virus (A/Taiwan/2192/96(H3N2)) N2 neuraminidase (NA) mRNA, partial cds | 392 bp linear mRNA | AF140626.1 GI: 4972986 |
| 261. Influenza A virus (A/Taiwan/2195/96 (H3N2)) polymerase basic protein 1 (PB1) mRNA, partial cds | 297 bp linear mRNA | AY303735.1 GI: 32330959 |
| 262. Influenza A virus (A/Taiwan/2195/96 (H3N2)) hemagglutinin (HA) mRNA, partial cds | 844 bp linear mRNA | AY303736.1 GI: 32330961 |
| 263. Influenza A virus (A/Taiwan/224/98(H3N2)) matrix protein M1 (M) mRNA, partial cds | 875 bp linear mRNA | AF138718.2 GI: 4996885 |
| 264. Influenza A virus (A/human/Taiwan/2548/99(H3N2)) hemagglutinin (HA) mRNA, partial cds | 844 bp linear mRNA | AF362817.1 GI: 15055134 |
| 265. Influenza A virus (A/Taiwan/268/2005(H3N2)) hemagglutinin (HA) mRNA, partial cds | 750 bp linear mRNA | EU068120.1 GI: 158452113 |

TABLE 8-continued

| Influenza H3N2 Antigens | | |
|---|---|---|
| Strain/Protein | Length | GenBank/GI Accession No. |
| 266. Influenza A virus (A/Taiwan/3008/2004(H3N2)) hemagglutinin (HA) mRNA, partial cds | 750 bp linear mRNA | EU068149.1 GI: 158452171 |
| 267. Influenza A virus (A/Taiwan/3075/2003(H3N2)) hemagglutinin (HA) mRNA, partial cds | 750 bp linear mRNA | EU068152.1 GI: 158452177 |
| 268. Influenza A virus (A/human/Taiwan/3083/00(H3N2)) hemagglutinin (HA) mRNA, partial cds | 940 bp linear mRNA | AF362818.1 GI: 15055136 |
| 269. Influenza A virus (A/Taiwan/3131/2002(H3N2)) hemagglutinin mRNA, partial cds | 791 bp linear mRNA | AY604811.1 GI: 50727502 |
| 270. Influenza A virus (A/Taiwan/3154/2004(H3N2)) hemagglutinin (HA) mRNA, partial cds | 750 bp linear mRNA | EU068145.1 GI: 158452163 |
| 271. Influenza A virus (A/Taiwan/3187/2004(H3N2)) hemagglutinin (HA) mRNA, partial cds | 750 bp linear mRNA | EU068141.1 GI: 158452155 |
| 272. Influenza A virus (A/Taiwan/3245/2004(H3N2)) hemagglutinin (HA) mRNA, partial cds | 750 bp linear mRNA | EU068134.1 GI: 158452141 |
| 273. Influenza A virus (A/Taiwan/3294/2005(H3N2)) hemagglutinin (HA) mRNA, partial cds | 750 bp linear mRNA | EU068133.1 GI: 158452139 |
| 274. Influenza A virus (A/Taiwan/3351/97(H3N2)) H3 hemagglutinin (HA) mRNA, partial cds | 861 bp linear mRNA | AF139935.1 GI: 4972934 |
| 275. Influenza A virus (A/Taiwan/3351/97(H3N2)) N2 neuraminidase (NA) mRNA, partial cds | 392 bp linear mRNA | AF140625.1 GI: 4972984 |
| 276. Influenza A virus (A/Taiwan/3351/97(H3N2)) matrix protein M1 (M) mRNA, partial cds | 875 bp linear mRNA | AF138713.2 GI: 4996875 |
| 277. Influenza A virus (A/Taiwan/3351/97(H3N2)) polymerase basic protein 1 (PB1) mRNA, partial cds | 297 bp linear mRNA | AY303738.1 GI: 32330965 |
| 278. Influenza A virus (A/Taiwan/3387/2005(H3N2)) hemagglutinin (HA) mRNA, partial cds | 750 bp linear mRNA | EU068132.1 GI: 158452137 |
| 279. Influenza A virus (A/Taiwan/3396/97 (H3N2)) polymerase basic protein 1 (PB1) mRNA, partial cds | 297 bp linear mRNA | AY303742.1 GI: 32330973 |
| 280. Influenza A virus (A/Taiwan/3396/97 (H3N2)) hemagglutinin (HA) mRNA, partial cds | 844 bp linear mRNA | AY303743.1 GI: 32330975 |
| 281. Influenza A virus (A/Taiwan/3427/97(H3N2)) H3 hemagglutinin (HA) mRNA, partial cds | 861 bp linear mRNA | AF139930.1 GI: 4972924 |
| 282. Influenza A virus (A/Taiwan/3427/97(H3N2)) N2 neuraminidase (NA) mRNA, partial cds | 392 bp linear mRNA | AF140619.1 GI: 4972972 |
| 283. Influenza A virus (A/Taiwan/346/98(H3N2)) H3 hemagglutinin (HA) mRNA, partial cds | 861 bp linear mRNA | AF139940.1 GI: 4972944 |
| 284. Influenza A virus (A/Taiwan/346/98(H3N2)) N2 neuraminidase (NA) mRNA, partial cds | 392 bp linear mRNA | AF140787.1 GI: 4972992 |
| 285. Influenza A virus (A/Taiwan/346/98(H3N2)) matrix protein M1 (M) mRNA, partial cds | 875 bp linear mRNA | AF138719.2 GI: 4996887 |
| 286. Influenza A virus (A/human/Taiwan/3460/00(H3N2)) truncated hemagglutinin (HA) mRNA, partial cds | 942 bp linear mRNA | AF362819.1 GI: 15055138 |
| 287. Influenza A virus (A/Taiwan/3469/97(H3N2)) H3 hemagglutinin (HA) mRNA, partial cds | 861 bp linear mRNA | AF139933.1 GI: 4972930 |
| 288. Influenza A virus (A/Taiwan/3469/97(H3N2)) N2 neuraminidase (NA) mRNA, partial cds | 392 bp linear mRNA | AF140623.1 GI: 4972980 |
| 289. Influenza A virus (A/Taiwan/3469/97(H3N2)) matrix protein M1 (M) mRNA, partial cds | 875 bp linear mRNA | AF138714.2 GI: 4996877 |
| 290. Influenza A virus (A/Taiwan/3503/97 (H3N2)) polymerase basic protein 1 (PB1) mRNA, partial cds | 297 bp linear mRNA | AY303744.1 GI: 32330977 |

TABLE 8-continued

Influenza H3N2 Antigens

| Strain/Protein | Length | GenBank/GI Accession No. |
|---|---|---|
| 291. Influenza A virus (A/Taiwan/3503/97 (H3N2)) hemagglutinin (HA) mRNA, partial cds | 844 bp linear mRNA | AY303745.1 GI: 32330979 |
| 292. Influenza A virus (A/Taiwan/3513/96(H3N2)) matrix protein M1 (M) mRNA, partial cds | 919 bp linear mRNA | AF138712.1 GI: 4928900 |
| 293. Influenza A virus (A/Taiwan/3513/97(H3N2)) H3 hemagglutinin (HA) mRNA, partial cds | 861 bp linear mRNA | AF139931.1 GI: 4972926 |
| 294. Influenza A virus (A/Taiwan/3513/97(H3N2)) N2 neuraminidase (NA) mRNA, partial cds | 392 bp linear mRNA | AF140621.1 GI: 4972976 |
| 295. Influenza A virus (A/Taiwan/3744/2002(H3N2)) hemagglutinin mRNA, partial cds | 791 bp linear mRNA | AY604814.1 GI: 50727508 |
| 296. Influenza A virus (A/human/Taiwan/3760/00(H3N2)) hemagglutinin (HA) mRNA, partial cds | 940 bp linear mRNA | AF362804.1 GI: 15055108 |
| 297. Influenza A virus (A/Taiwan/3896/2001 (H1N1)) hemagglutinin (HA) mRNA, partial cds | 561 bp linear mRNA | AY303747.1 GI: 32330983 |
| 298. Influenza A virus (A/Taiwan/4050/2003(H3N2)) hemagglutinin mRNA, partial cds | 791 bp linear mRNA | AY604825.1 GI: 50727530 |
| 299. Influenza A virus (A/Taiwan/4063/2003(H3N2)) hemagglutinin mRNA, partial cds | 791 bp linear mRNA | AY604824.1 GI: 50727528 |
| 300. Influenza A virus (A/Taiwan/41/2004(H3N2)) hemagglutinin (HA) mRNA, partial cds | 750 bp linear mRNA | EU068137.1 GI: 158452147 |
| 301. Influenza A virus (A/Taiwan/45/98(H3N2)) H3 hemagglutinin (HA) mRNA, partial cds | 861 bp linear mRNA | AF139939.1 GI: 4972942 |
| 302. Influenza A virus (A/Taiwan/45/98(H3N2)) N2 neuraminidase (NA) mRNA, partial cds | 392 bp linear mRNA | AF140628.1 GI: 4972990 |
| 303. Influenza A virus (A/Taiwan/45/98(H3N2)) matrix protein M1 (M) mRNA, partial cds | 875 bp linear mRNA | AF138717.2 GI: 4996883 |
| 304. Influenza A virus (A/Taiwan/4548/2003(H3N2)) hemagglutinin (HA) mRNA, partial cds | 750 bp linear mRNA | EU068114.1 GI: 158452101 |
| 305. Influenza A virus (A/Taiwan/4673/2002(H3N2)) hemagglutinin mRNA, partial cds | 791 bp linear mRNA | AY604813.1 GI: 50727506 |
| 306. Influenza A virus (A/Taiwan/4680/2002(H3N2)) hemagglutinin mRNA, partial cds | 791 bp linear mRNA | AY604812.1 GI: 50727504 |
| 307. Influenza A virus (A/Taiwan/4735/2004(H3N2)) hemagglutinin (HA) mRNA, partial cds | 750 bp linear mRNA | EU068136.1 GI: 158452145 |
| 308. Influenza A virus (A/Taiwan/4829/2005(H3N2)) hemagglutinin (HA) mRNA, partial cds | 750 bp linear mRNA | EU068142.1 GI: 158452157 |
| 309. Influenza A virus (A/Taiwan/4836/2005(H3N2)) hemagglutinin (HA) mRNA, partial cds | 750 bp linear mRNA | EU068130.1 GI: 158452133 |
| 310. Influenza A virus (A/Taiwan/4865/2005(H3N2)) hemagglutinin (HA) mRNA, partial cds | 750 bp linear mRNA | EU068143.1 GI: 158452159 |
| 311. Influenza A virus (A/Taiwan/4883/2005(H3N2)) hemagglutinin (HA) mRNA, partial cds | 750 bp linear mRNA | EU068121.1 GI: 158452115 |
| 312. Influenza A virus (A/Taiwan/4938/2002(H3N2)) hemagglutinin mRNA, partial cds | 791 bp linear mRNA | AY604809.1 GI: 50727498 |
| 313. Influenza A virus (A/Taiwan/4954/2002(H3N2)) hemagglutinin mRNA, partial cds | 791 bp linear mRNA | AY604815.1 GI: 50727510 |
| 314. Influenza A virus (A/Taiwan/4963/2002(H3N2)) hemagglutinin mRNA, partial cds | 791 bp linear mRNA | AY604810.1 GI: 50727500 |
| 315. Influenza A virus (A/Taiwan/4987/2005(H3N2)) hemagglutinin (HA) mRNA, partial cds | 750 bp linear mRNA | EU068122.1 GI: 158452117 |

TABLE 8-continued

| Influenza H3N2 Antigens | | |
|---|---|---|
| Strain/Protein | Length | GenBank/GI Accession No. |
| 316. Influenza A virus (A/Taiwan/4990/2005(H3N2)) hemagglutinin (HA) mRNA, partial cds | 750 bp linear mRNA | EU068127.1 GI: 158452127 |
| 317. Influenza A virus (A/Taiwan/5/2003(H3N2)) hemagglutinin (HA) mRNA, partial cds | 750 bp linear mRNA | EU068118.1 GI: 158452109 |
| 318. Influenza A virus (A/Taiwan/5153/2002(H3N2)) hemagglutinin mRNA, partial cds | 791 bp linear mRNA | AY604816.1 GI: 50727512 |
| 319. Influenza A virus (A/Taiwan/5267/2005(H3N2)) hemagglutinin (HA) mRNA, partial cds | 750 bp linear mRNA | EU068128.1 GI: 158452129 |
| 320. Influenza A virus (A/Taiwan/556/2004(H3N2)) hemagglutinin (HA) mRNA, partial cds | 750 bp linear mRNA | EU068146.1 GI: 158452165 |
| 321. Influenza A virus (A/Taiwan/5694/2005(H3N2)) hemagglutinin (HA) mRNA, partial cds | 750 bp linear mRNA | EU068126.1 GI: 158452125 |
| 322. Influenza A virus (A/Taiwan/587/2004(H3N2)) hemagglutinin (HA) mRNA, partial cds | 750 bp linear mRNA | EU068147.1 GI: 158452167 |
| 323. Influenza A virus (A/Taiwan/592/2004(H3N2)) hemagglutinin (HA) mRNA, partial cds | 750 bp linear mRNA | EU068151.1 GI: 158452175 |
| 324. Influenza A virus (A/Taiwan/7099/2003(H3N2)) hemagglutinin mRNA, partial cds | 791 bp linear mRNA | AY604829.1 GI: 50727538 |
| 325. Influenza A virus (A/Taiwan/7100/2003(H3N2)) hemagglutinin mRNA, partial cds | 791 bp linear mRNA | AY604830.1 GI: 50727540 |
| 326. Influenza A virus (A/Taiwan/7196/2003(H3N2)) hemagglutinin (HA) mRNA, partial cds | 750 bp linear mRNA | EU068150.1 GI: 158452173 |
| 327. Influenza A virus (A/Taiwan/7568/2004(H3N2)) hemagglutinin (HA) mRNA, partial cds | 750 bp linear mRNA | EU068135.1 GI: 158452143 |
| 328. Influenza A virus (A/Taiwan/7601/2005(H3N2)) hemagglutinin (HA) mRNA, partial cds | 750 bp linear mRNA | EU068144.1 GI: 158452161 |
| 329. Influenza A virus (A/Taiwan/7681/2005(H3N2)) hemagglutinin (HA) mRNA, partial cds | 750 bp linear mRNA | EU068124.1 GI: 158452121 |
| 330. Influenza A virus (A/Taiwan/7702/2005(H3N2)) hemagglutinin (HA) mRNA, partial cds | 750 bp linear mRNA | EU068123.1 GI: 158452119 |
| 331. Influenza A virus (A/Taiwan/7873/2005(H3N2)) hemagglutinin (HA) mRNA, partial cds | 750 bp linear mRNA | EU068129.1 GI: 158452131 |
| 332. Influenza A virus (A/Taiwan/8/2003(H3N2)) hemagglutinin (HA) mRNA, partial cds | 750 bp linear mRNA | EU068115.1 GI: 158452103 |
| 333. Influenza A virus (A/Taiwan/93/2004(H3N2)) hemagglutinin (HA) mRNA, partial cds | 750 bp linear mRNA | EU068140.1 GI: 158452153 |
| 334. Influenza A virus (A/Taoyuan/108/02(H3N2)) hemagglutinin (HA) mRNA, partial cds | 528 bp linear mRNA | AY962016.1 GI: 68138189 |
| 335. Influenza A virus (A/Taoyuan/108/02(H3N2)) neuraminidase (NA) mRNA, partial cds | 754 bp linear mRNA | AY973338.1 GI: 70673232 |
| 336. Influenza A virus (A/Taoyuan/108/02(H3N2)) nucleoprotein (NP) mRNA, partial cds | 882 bp linear mRNA | AY986998.1 GI: 70728123 |
| 337. Influenza A virus (A/Thailand/CU124/2006(H3N2)) neuraminidase (NA) mRNA, complete cds | 1,410 bp linear mRNA | EU021285.1 GI: 154224724 |
| 338. Influenza A virus (A/Thailand/CU124/2006(H3N2)) hemagglutinin (HA) mRNA, complete cds | 1,701 bp linear mRNA | EU021284.1 GI: 154224795 |
| 339. Influenza A virus (A/Thailand/CU228/2006(H3N2)) neuraminidase (NA) mRNA, complete cds | 1,410 bp linear mRNA | EU021275.1 GI: 154224714 |
| 340. Influenza A virus (A/Thailand/CU228/2006(H3N2)) hemagglutinin (HA) mRNA, complete cds | 1,701 bp linear mRNA | EU021274.1 GI: 154224785 |

TABLE 8-continued

| Influenza H3N2 Antigens | | |
|---|---|---|
| Strain/Protein | Length | GenBank/GI Accession No. |
| 341. Influenza A virus (A/Thailand/CU23/2006(H3N2)) neuraminidase (NA) mRNA, partial cds | 1,347 bp linear mRNA | EU021267.1 GI: 154224706 |
| 342. Influenza A virus (A/Thailand/CU23/2006(H3N2)) hemagglutinin (HA) mRNA, complete cds | 1,701 bp linear mRNA | EU021266.1 GI: 154224777 |
| 343. Influenza A virus (A/Thailand/CU231/2006(H3N2)) neuraminidase (NA) mRNA, complete cds | 1,410 bp linear mRNA | EU021283.1 GI: 154224722 |
| 344. Influenza A virus (A/Thailand/CU231/2006(H3N2)) hemagglutinin (HA) mRNA, complete cds | 1,701 bp linear mRNA | EU021282.1 GI: 154224793 |
| 345. Influenza A virus (A/Thailand/CU259/2006(H3N2)) neuraminidase (NA) mRNA, complete cds | 1,410 bp linear mRNA | EU021279.1 GI: 154224718 |
| 346. Influenza A virus (A/Thailand/CU259/2006(H3N2)) hemagglutinin (HA) mRNA, complete cds | 1,701 bp linear mRNA | EU021278.1 GI: 154224789 |
| 347. Influenza A virus (A/Thailand/CU260/2006(H3N2)) neuraminidase (NA) mRNA, complete cds | 1,410 bp linear mRNA | EU021281.1 GI: 154224720 |
| 348. Influenza A virus (A/Thailand/CU260/2006(H3N2)) hemagglutinin (HA) mRNA, partial cds | 1,129 bp linear mRNA | EU021280.1 GI: 154224791 |
| 349. Influenza A virus (A/Thailand/CU272/2007(H3N2)) neuraminidase (NA) mRNA, complete cds | 1,410 bp linear mRNA | EU021271.1 GI: 154224710 |
| 350. Influenza A virus (A/Thailand/CU272/2007(H3N2)) hemagglutinin (HA) mRNA, complete cds | 1,701 bp linear mRNA | EU021270.1 GI: 154224781 |
| 351. Influenza A virus (A/Thailand/CU280/2007(H3N2)) neuraminidase (NA) mRNA, complete cds | 1,410 bp linear mRNA | EU021273.1 GI: 154224712 |
| 352. Influenza A virus (A/Thailand/CU280/2007(H3N2)) hemagglutinin (HA) mRNA, complete cds | 1,701 bp linear mRNA | EU021272.1 GI: 154224783 |
| 353. Influenza A virus (A/Thailand/CU282/2007(H3N2)) neuraminidase (NA) mRNA, complete cds | 1,410 bp linear mRNA | EU021277.1 GI: 154224716 |
| 354. Influenza A virus (A/Thailand/CU282/2007(H3N2)) hemagglutinin (HA) mRNA, complete cds | 1,701 bp linear mRNA | EU021276.1 GI: 154224787 |
| 355. Influenza A virus (A/Thailand/CU32/2006(H1N1)) neuraminidase (NA) mRNA, complete cds | 1,413 bp linear mRNA | EU021265.1 GI: 154224704 |
| 361. Influenza A virus (A/Thailand/CU46/2006(H3N2)) neuraminidase (NA) mRNA, complete cds | 1,410 bp linear mRNA | EU021269.1 GI: 154224708 |
| 362. Influenza A virus (A/Thailand/CU46/2006(H3N2)) hemagglutinin (HA) mRNA, complete cds | 1,701 bp linear mRNA | EU021268.1 GI: 154224779 |
| 377. Influenza A virus (A/Tottori/849AM1AL3/1994(H3N2)) hemagglutinin (HA) mRNA, partial cds | 987 bp linear mRNA | U77837.1 GI: 2992515 |
| 378. Influenza A virus (A/Tottori/849AM2/1994(H3N2)) hemagglutinin (HA) mRNA, partial cds | 987 bp linear mRNA | U77833.1 GI: 2992507 |
| 379. Influenza A virus (A/Tottori/849AM2AL3/1994(H3N2)) hemagglutinin (HA) mRNA, partial cds | 987 bp linear mRNA | U77839.1 GI: 2992519 |
| 380. Influenza A virus (A/Tottori/849AM4/1994(H3N2)) hemagglutinin (HA) mRNA, partial cds | 987 bp linear mRNA | U77835.1 GI: 2992511 |
| 382. Influenza A virus (A/Tottori/872AM2/1994(H3N2)) hemagglutinin (HA) mRNA, partial cds | 987 bp linear mRNA | U77834.1 GI: 2992509 |
| 383. Influenza A virus (A/Tottori/872AM2AL3/1994(H3N2)) hemagglutinin (HA) mRNA, partial cds | 987 bp linear mRNA | U77840.1 GI: 2992521 |
| 384. Influenza A virus (A/Tottori/872AM4/1994(H3N2)) hemagglutinin (HA) mRNA, partial cds | 987 bp linear mRNA | U77836.1 GI: 2992513 |
| 385. Influenza A virus (A/Tottori/872K4/1994(H3N2)) hemagglutinin (HA) mRNA, partial cds | 987 bp linear mRNA | U77832.1 GI: 2992505 |

TABLE 8-continued

| Influenza H3N2 Antigens | | |
|---|---|---|
| Strain/Protein | Length | GenBank/GI Accession No. |
| 386. Influenza A virus (A/United Kingdom/26554/99(H3N2)) hemagglutinin (HA) mRNA, partial cds | 987 bp linear mRNA | AF501529.1 GI: 21314314 |
| 387. Influenza A virus (A/United Kingdom/34300/99(H3N2)) hemagglutinin (HA) mRNA, partial cds | 987 bp linear mRNA | AF501527.1 GI: 21314310 |
| 388. Influenza A virus (A/Utah/20997/99(H3N2)) hemagglutinin (HA) mRNA, partial cds | 987 bp linear mRNA | AF501533.1 GI: 21314322 |
| 389. Influenza A virus (A/Victoria/3/75) segment 5 nucleoprotein mRNA, complete cds | 1,565 bp linear mRNA | AF072545.1 GI: 4218933 |
| 390. Influenza A virus (A/Vienna/47/96M(H3N2)) hemagglutinin (HA) mRNA, complete cds | 1,762 bp linear mRNA | AF017270.2 GI: 14286338 |
| 391. Influenza A virus (A/Vienna/47/96V(H3N2)) hemagglutinin (HA) mRNA, complete cds | 1,762 bp linear mRNA | AF017272.2 GI: 15004991 |
| 392. Influenza A virus (A/Vienna/81/96V(H3N2)) hemagglutinin (HA) mRNA, partial cds | 1,069 bp linear mRNA | AF017271.1 GI: 2407251 |
| 393. Influenza A virus (A/Virginia/21712/99(H3N2)) hemagglutinin (HA) mRNA, partial cds | 987 bp linear mRNA | AF501532.1 GI: 21314320 |
| 394. Influenza A virus (A/Virginia/21716/99(H3N2)) hemagglutinin (HA) mRNA, partial cds | 987 bp linear mRNA | AF501515.1 GI: 21314286 |
| 395. Influenza A virus (A/Virginia/21735/99(H3N2)) hemagglutinin (HA) mRNA, partial cds | 987 bp linear mRNA | AF501530.1 GI: 21314316 |
| 396. Influenza A virus (A/Virginia/21743/99(H3N2)) hemagglutinin (HA) mRNA, partial cds | 987 bp linear mRNA | AF501524.1 GI: 21314304 |
| 397. Influenza A virus (A/Virginia/21754/99(H3N2)) hemagglutinin (HA) mRNA, partial cds | 987 bp linear mRNA | AF501519.1 GI: 21314294 |
| 398. Influenza A virus (A/Virginia/21799/99(H3N2)) hemagglutinin (HA) mRNA, partial cds | 987 bp linear mRNA | AF501523.1 GI: 21314302 |
| 399. Influenza A virus (A/Virginia/21817/99(H3N2)) hemagglutinin (HA) mRNA, partial cds | 987 bp linear mRNA | AF501525.1 GI: 21314306 |
| 400. Influenza A virus (A/Virginia/21822/99(H3N2)) hemagglutinin (HA) mRNA, partial cds | 987 bp linear mRNA | AF501520.1 GI: 21314296 |
| 401. Influenza A virus (A/Virginia/21828/99(H3N2)) hemagglutinin (HA) mRNA, partial cds | 987 bp linear mRNA | AF501528.1 GI: 21314312 |
| 402. Influenza A virus (A/Virginia/21833/99(H3N2)) hemagglutinin (HA) mRNA, partial cds | 987 bp linear mRNA | AF501517.1 GI: 21314290 |
| 403. Influenza A virus (A/Virginia/21845/99(H3N2)) hemagglutinin (HA) mRNA, partial cds | 987 bp linear mRNA | AF501522.1 GI: 21314300 |
| 404. Influenza A virus (A/Virginia/21847/99(H3N2)) hemagglutinin (HA) mRNA, partial cds | 987 bp linear mRNA | AF501535.1 GI: 21314326 |
| 405. Influenza A virus (A/Virginia/G1/99(H3N2)) hemagglutinin (HA) mRNA, partial cds | 987 bp linear mRNA | AF501521.1 GI: 21314298 |
| 406. Influenza A virus (A/Yilan/508/03(H3N2)) neuraminidase (NA) mRNA, partial cds | 755 bp linear mRNA | AY973339.1 GI: 70673234 |
| 407. Influenza A virus (A/Yilan/508/03(H3N2)) nucleoprotein (NP) mRNA, partial cds | 882 bp linear mRNA | AY986999.1 GI: 70728125 |
| 408. Influenza A virus (A/Yilan/513/03(H3N2)) hemagglutinin (HA) mRNA, partial cds | 740 bp linear mRNA | AY962015.1 GI: 68138187 |
| 409. Influenza A virus (A/Yilan/513/03(H3N2)) neuraminidase (NA) mRNA, partial cds | 396 bp linear mRNA | AY973340.1 GI: 70673236 |
| 410. Influenza A virus (A/Yilan/513/03(H3N2)) nucleoprotein (NP) mRNA, partial cds | 882 bp linear mRNA | AY987000.1 GI: 70728127 |

TABLE 8-continued

| Influenza H3N2 Antigens | | |
|---|---|---|
| Strain/Protein | Length | GenBank/GI Accession No. |
| 411. Influenza A virus (A/Yilan/515/03(H3N2)) hemagglutinin (HA) mRNA, partial cds | 511 bp linear mRNA | AY962010.1 GI: 68138177 |
| 412. Influenza A virus (A/Yilan/515/03(H3N2)) neuraminidase (NA) mRNA, partial cds | 394 bp linear mRNA | AY973341.1 GI: 70673238 |
| 413. Influenza A virus (A/Yilan/516/03(H3N2)) nucleoprotein (NP) mRNA, partial cds | 882 bp linear mRNA | AY987001.1 GI: 70728129 |
| 414. Influenza A virus (A/Yilan/518/03(H3N2)) hemagglutinin (HA) mRNA, partial cds | 530 bp linear mRNA | AY962006.1 GI: 68138169 |
| 415. Influenza A virus (A/Yilan/518/03(H3N2)) neuraminidase (NA) mRNA, partial cds | 397 bp linear mRNA | AY973342.1 GI: 70673240 |
| 416. Influenza A virus (A/Yilan/518/03(H3N2)) nucleoprotein (NP) mRNA, partial cds | 882 bp linear mRNA | AY987002.1 GI: 70728131 |
| 417. Influenza A virus (A/Yilan/538/04(H3N2)) hemagglutinin (HA) mRNA, partial cds | 777 bp linear mRNA | AY962002.1 GI: 68138161 |
| 418. Influenza A virus (A/Yilan/538/04(H3N2)) neuraminidase (NA) mRNA, partial cds | 783 bp linear mRNA | AY973343.1 GI: 70673242 |
| 419. Influenza A virus (A/Yilan/538/04(H3N2)) nucleoprotein (NP) mRNA, partial cds | 882 bp linear mRNA | AY987003.1 GI: 70728133 |
| 420. Influenza A virus (A/Yilan/549/04(H3N2)) hemagglutinin (HA) mRNA, partial cds | 788 bp linear mRNA | AY962003.1 GI: 68138163 |
| 421. Influenza A virus (A/Yilan/549/04(H3N2)) neuraminidase (NA) mRNA, partial cds | 779 bp linear mRNA | AY973344.1 GI: 70673244 |
| 422. Influenza A virus (A/Yilan/549/04(H3N2)) nucleoprotein (NP) mRNA, partial cds | 882 bp linear mRNA | AY987004.1 GI: 70728135 |
| 423. Influenza A virus (A/Yilan/557/04(H3N2)) hemagglutinin (HA) mRNA, partial cds | 776 bp linear mRNA | AY962013.1 GI: 68138183 |
| 424. Influenza A virus (A/Yilan/557/04(H3N2)) neuraminidase (NA) mRNA, partial cds | 796 bp linear mRNA | AY973345.1 GI: 70673246 |
| 425. Influenza A virus (A/Yilan/557/04(H3N2)) nucleoprotein (NP) mRNA, partial cds | 882 bp linear mRNA | AY987005.1 GI: 70728137 |
| 426. Influenza A virus (A/Yilan/566/04(H3N2)) hemagglutinin (HA) mRNA, partial cds | 753 bp linear mRNA | AY962014.1 GI: 68138185 |
| 427. Influenza A virus (A/Yilan/566/04(H3N2)) neuraminidase (NA) mRNA, partial cds | 808 bp linear mRNA | AY973346.1 GI: 70673248 |
| 428. Influenza A virus (A/Yilan/566/04(H3N2)) nucleoprotein (NP) mRNA, partial cds | 882 bp linear mRNA | AY987006.1 GI: 70728139 |
| 429. Influenza A virus (A/zhejiang/06/99(H3N2)) hemagglutinin (HA) mRNA, partial cds | 987 bp linear mRNA | AY138513.1 GI: 24895131 |
| 430. Influenza A virus (A/zhejiang/10/98(H3N2)) hemagglutinin (HA) mRNA, partial cds | 987 bp linear mRNA | AY138515.1 GI: 24895149 |
| 431. Influenza A virus (A/zhejiang/11/2002(H3N2)) hemagglutinin (HA) mRNA, partial cds | 987 bp linear mRNA | AY138516.1 GI: 24895159 |
| 432. Influenza A virus (A/zhejiang/12/99(H3N2)) hemagglutinin-like (HA) mRNA, partial sequence | 987 bp linear mRNA | AY138514.1 GI: 24895141 |
| 433. Influenza A virus (A/zhejiang/8/2002(H3N2)) hemagglutinin (HA) mRNA, partial cds | 987 bp linear mRNA | AY138519.1 GI: 24895188 |
| 434. Influenza A virus H3N2 strain A/Akita/1/94 nonstructural protein 1 and nonstructural protein 2 mRNAs, complete cds | 840 bp linear mRNA | U65670.1 GI: 3929405 |
| 435. Influenza A virus H3N2 strain A/Akita/1/95 nonstructural protein 1 and nonstructural protein 2 mRNAs, complete cds | 840 bp linear mRNA | U65671.1 GI: 3929408 |

TABLE 8-continued

Influenza H3N2 Antigens

| Strain/Protein | Length | GenBank/GI Accession No. |
|---|---|---|
| 436. Influenza A virus H3N2 strain A/Shiga/20/95 nonstructural protein 1 and nonstructural protein 2 mRNAs, complete cds | 840 bp linear mRNA | U65673.1 GI: 3929411 |
| 437. Influenza A virus H3N2 strain A/Miyagi/69/95 nonstructural protein 1 and nonstructural protein 2 mRNAs, complete cds | 840 bp linear mRNA | U65674.1 GI: 3929414 |
| 438. Influenza A virus H3N2 strain A/Hebei/19/95 nonstructural protein 1 and nonstructural protein 2 mRNAs, complete cds | 840 bp linear mRNA | U65672.1 GI: 6468319 |
| A/Aichi/69/1994(H3N2) haemagglutinin | | U48446.1 |
| A/Bangkok/1/1979 (H3N2) hemagglutinin (HA) | | AF201843.1 |
| A/Beijing/353/89(H3) hemagglutinin (HA) | | U97740.1 |
| A/Beijing/353/1989(H3N2) haemagglutinin | | Z46391.1 |
| A/chicken/Singapore/2002(H3N2) M2 protein | | EU014143.1 |
| A/Christ Hospital/231/82(H3N2)) hemagglutinin (HA) | | U77830.1 |
| A/duck/Eastern China/36/2002(H3N2) segment 6 neuraminidase (NA) | | EU429701.1 |
| A/duck/Eastern China/160/2003(H3N2) segment 6 neuraminidase (NA) | | EU429732.1 |
| A/duck/Eastern China/848/2003(H3N2) segment 6 neuraminidase (NA) | | EU429721.1 |
| A/duck/Eastern China/770/2003(H3N2) segment 6 neuraminidase (NA) | | EU429736.1 |
| A/duck/Eastern China/855/2003(H3N2) segment 6 neuraminidase (NA) | | EU429737.1 |
| A/duck/Eastern China/875/2003(H3N2) segment 6 neuraminidase (NA) | | EU429738.1 |
| A/duck/Eastern China/901/2003(H3N2) segment 6 neuraminidase (NA) | | EU429739.1 |
| A/duck/Eastern China/866/2003(H3N2) segment 6 neuraminidase (NA) | | EU429756.1 |
| A/duck/Eastern China/857/2003(H3N2) segment 6 neuraminidase (NA) | | EU429761.1 |
| A/duck/Eastern China/852/2003(H3N2) segment 6 neuraminidase (NA) | | EU429767.1 |
| A/duck/Eastern China/838/2003(H3N2) segment 6 neuraminidase (NA) | | EU429720.1 |
| A/duck/Eastern China/6/2004(H3N2) segment 6 neuraminidase (NA) | | EU429745.1 |
| A/duck/Eastern China/03/2005(H3N2) segment 6 neuraminidase (NA) | | EU429781.1 |
| A/duck/Eastern China/02/2006(H3N2) segment 6 neuraminidase (NA) | | EU429769.1 |
| A/duck/Eastern China/04/2006(H3N2) segment 6 neuraminidase (NA) | | EU429770.1 |
| A/duck/Eastern China/21/2006(H3N2) segment 6 neuraminidase (NA) | | EU429771.1 |
| A/duck/Eastern China/23/2006(H3N2) segment 6 neuraminidase (NA) | | EU429772.1 |
| A/duck/Eastern China/31/2006(H3N2) segment 6 neuraminidase (NA) | | EU429773.1 |
| A/duck/Eastern China/35/2006(H3N2) segment 6 neuraminidase (NA) | | EU429768.1 |
| A/duck/Eastern China/42/2006(H3N2) segment 6 neuraminidase (NA) | | EU429774.1 |
| A/duck/Eastern China/53/2006(H3N2) segment 6 neuraminidase (NA) | | EU429775.1 |
| A/duck/Eastern China/60/2006(H3N2) segment 6 neuraminidase (NA) | | EU429776.1 |
| A/duck/Eastern China/62/2006(H3N2) segment 6 neuraminidase (NA) | | EU429784.1 |
| A/duck/Eastern China/63/2006(H3N2) segment 6 neuraminidase (NA) | | EU429777.1 |
| A/duck/Eastern China/142/2006(H3N2) segment 6 neuraminidase (NA) | | EU429742.1 |
| A/Dunedin/4/1973 (H3N2) hemagglutinin (HA) | | AF201842.1 |

TABLE 9

| | Influenza H5N1 Antigens | |
|---|---|---|
| Strain/Protein | Length | GenBank/GI Accession No. |
| 1. Influenza A virus (A/chicken/Burkina Faso/01.03/2006(H5N1)) mRNA for nonstructural protein (ns gene) | 827 bp linear mRNA | AM503036.1 GI:147846308 |
| 2. Influenza A virus (A/chicken/Burkina Faso/13.1/2006(H5N1)) partial mRNA for matrix protein 1 (m1 gene) | 990 bp linear mRNA | AM503007.1 GI:147846250 |
| 3. Influenza A virus (A/chicken/Burkina Faso/13.1/2006(H5N1)) mRNA for nucleoprotein (np gene) | 1,529 bp linear mRNA | AM503029.1 GI:147846294 |
| 4. Influenza A virus (A/chicken/Burkina Faso/13.1/2006(H5N1)) mRNA for nonstructural protein (ns gene) | 827 bp linear mRNA | AM503037.1 GI:147846310 |
| 5. Influenza A virus (A/chicken/Burkina Faso/13.1/2006(H5N1)) partial mRNA for polymerase (pa gene) | 2,169 bp linear mRNA | AM503046.1 GI:147846328 |
| 6. Influenza A virus (A/chicken/Burkina Faso/13.1/2006(H5N1)) partial mRNA for polymerase basic protein 1 (pb1 gene) | 2,259 bp linear mRNA | AM503056.1 GI:147846348 |
| 7. Influenza A virus (A/chicken/Burkina Faso/13.1/2006(H5N1)) partial mRNA for polymerase basic protein 2 (pb2 gene) | 2,315 bp linear mRNA | AM503067.1 GI:147846859 |
| 8. Influenza A virus (A/chicken/China/1/02(H5N1)) hemagglutinin (HA) mRNA, complete cds | 1,736 bp linear mRNA | DQ023145.1 GI:66775624 |
| 9. Influenza A virus (A/chicken/China/1/02(H5N1)) nucleoprotein (NP) mRNA, complete cds | 1,509 bp linear mRNA | DQ023146.1 GI:66775626 |
| 10. Influenza A virus (A/chicken/China/1/02(H5N1)) neuraminidase (NA) mRNA, complete cds | 1,379 bp linear mRNA | DQ023147.1 GI:66775628 |
| 11. Influenza A virus (A/chicken/Crimea/04/2005(H5N1)) matrix protein (M) mRNA, complete cds | 999 bp linear mRNA | DQ650660.1 GI:109692767 |
| 12. Influenza A virus (A/chicken/Crimea/04/2005(H5N1)) nonstructural protein (NS) mRNA, complete cds | 850 bp linear mRNA | DQ650662.1 GI:109692771 |
| 13. Influenza A virus (A/chicken/Crimea/08/2005(H5N1)) matrix protein (M) mRNA, complete cds | 994 bp linear mRNA | DQ650664.1 GI:109692775 |
| 14. Influenza A virus (A/chicken/Crimea/08/2005(H5N1)) nucleoprotein (NP) mRNA, complete cds | 1,532 bp linear mRNA | DQ650666.1 GI:109692779 |
| 15. Influenza A virus (A/chicken/Crimea/08/2005(H5N1)) nonstructural protein (NS) mRNA, complete cds | 850 bp linear mRNA | DQ65066 7.1 GI:109692781 |
| 16. Influenza A virus (A/chicken/Crimea/08/2005(H5N1)) polymerase acidic protein (PA) mRNA, complete cds | 2,208 bp linear mRNA | DQ650668.1 GI:109692783 |
| 17. Influenza A virus (A/chicken/Crimea/08/2005(H5N1)) polymerase basic protein 2 (PB2) mRNA, complete cds | 2,305 bp linear mRNA | DQ650670.1 GI:109692787 |
| 18. Influenza A virus (A/chicken/Dovolnoe/03/2005(H5N1)) hemagglutinin (HA) mRNA, partial cds | 1,015 bp linear mRNA | DQ676838.1 GI:108782527 |
| 20. Influenza A virus (A/chicken/Guangxi/12/2004(H5N1)) polymerase PB2 mRNA, complete cds | 2,341 bp linear mRNA | DQ366327.1 GI:86753731 |
| 21. Influenza A virus (A/chicken/Guangxi/12/2004(H5N1)) polymerase PB1 mRNA, complete cds | 2,341 bp linear mRNA | DQ366328.1 GI:86753741 |
| 22. Influenza A virus (A/chicken/Guangxi/12/2004(H5N1)) PA protein mRNA, complete cds | 2,233 bp linear mRNA | DQ366329.1 GI:86753751 |
| 23. Influenza A virus (A/chicken/Guangxi/12/2004(H5N1)) nucleocapsid mRNA, complete cds | 1,565 bp linear mRNA | DQ366331.1 GI:86753771 |
| 24. Influenza A virus (A/chicken/Guangxi/12/2004(H5N1)) matrix protein mRNA, complete cds | 1,027 bp linear mRNA | DQ366333.1 GI:86753791 |
| 25. Influenza A virus (A/chicken/Hong Kong/258/97(H5N1)) hemagglutinin mRNA, complete cds | 1,718 bp linear mRNA | AF057291.1 GI:3068720 |
| 26. Influenza A virus (A/chicken/Hong Kong/258/97(H5N1)) neuraminidase mRNA, partial cds | 1,318 bp linear mRNA | AF057292.1 GI:3068722 |

TABLE 9-continued

| Influenza H5N1 Antigens | | |
|---|---|---|
| Strain/Protein | Length | GenBank/GI Accession No. |
| 27. Influenza A virus (A/chicken/Hong Kong/258/97(H5N1)) nucleoprotein mRNA, complete cds | 1,508 bp linear mRNA | AF057293.1 GI:3068724 |
| 28. Influenza A virus (A/Chicken/Hong Kong/728/97 (H5N1)) hemagglutinin H5 mRNA, complete cds | 1,726 bp linear mRNA | AF082034.1 GI:4240435 |
| 29. Influenza A virus (A/Chicken/Hong Kong/786/97 (H5N1)) hemagglutinin H5 mRNA, complete cds | 1,726 bp linear mRNA | AF082035.1 GI:4240437 |
| 30. Influenza A virus (A/chicken/Hong Kong/915/97(H5N1)) hemagglutinin H5 mRNA, complete cds | 1,726 bp linear mRNA | AF082036.1 GI:4240439 |
| 31. Influenza A virus (A/chicken/Hong Kong/990/97 (H5N1)) hemagglutinin H5 mRNA, partial cds | 1,091 bp linear mRNA | AF082037.1 GI:4240441 |
| 32. Influenza A virus (A/chicken/Krasnodar/01/2006(H5N1)) matrix protein 1 (M) mRNA, complete cds | 1,002 bp linear mRNA | DQ676835.1 GI:108782521 |
| 33. Influenza A virus (A/chicken/Krasnodar/01/2006(H5N1)) nonstructural protein (NS) mRNA, complete cds | 850 bp linear mRNA | DQ676837.1 GI:108782525 |
| 34. Influenza A virus (A/chicken/Kurgan/05/2005(H5N1)) hemagglutinin (HA) mRNA, complete cds | 1,754 bp linear mRNA | DQ449632.1 GI:90289625 |
| 35. Influenza A virus (A/chicken/Kurgan/05/2005(H5N1)) matrix protein 1 (M) mRNA, complete cds | 1,002 bp linear mRNA | DQ449633.1 GI:90289627 |
| 36. Influenza A virus (A/chicken/Kurgan/05/2005(H5N1)) neuraminidase (NA) mRNA, complete cds | 1,373 bp linear mRNA | DQ449634.1 GI:90289629 |
| 37. Influenza A virus (A/chicken/Kurgan/05/2005(H5N1)) nucleoprotein (NP) mRNA, complete cds | 1,540 bp linear mRNA | DQ449635.1 GI:90289631 |
| 38. Influenza A virus (A/chicken/Kurgan/05/2005(H5N1)) nonstructural protein (NS) mRNA, complete cds | 850 bp linear mRNA | DQ449636.1 GI:90289633 |
| 39. Influenza A virus (A/chicken/Kurgan/05/2005(H5N1)) polymerase acidic protein (PA) mRNA, complete cds | 2,208 bp linear mRNA | DQ449637.1 GI:90289635 |
| 40. Influenza A virus (A/chicken/Kurgan/05/2005(H5N1)) polymerase basic protein 1 (PB1) mRNA, complete cds | 2,316 bp linear mRNA | DQ449638.1 GI:90289637 |
| 41. Influenza A virus (A/chicken/Kurgan/05/2005(H5N1)) polymerase basic protein 2 (PB2) mRNA, complete cds | 2,316 bp linear mRNA | DQ449639.1 GI:90289646 |
| 42. Influenza A virus (A/chicken/Lobzenko/01/2008(H5N1)) hemagglutinin (HA) mRNA, partial cds | 184 bp linear mRNA | EU447276.1 GI:168998217 |
| 43. Influenza A virus (A/chicken/Mahachkala/05/2006(H5N1)) matrix protein 1 (M) mRNA, complete cds | 1,002 bp linear mRNA | DQ676831.1 GI:108782513 |
| 44. Influenza A virus (A/chicken/Mahachkala/05/2006(H5N1)) nonstructural protein (NS) mRNA, complete cds | 850 bp linear mRNA | DQ676833.1 GI:108782517 |
| 45. Influenza A virus (A/chicken/Nigeria/AB13/2006(H5N1)) mRNA for nucleoprotein (np gene) | 1,531 bp linear mRNA | AM503030.1 GI:147846296 |
| 46. Influenza A virus (A/chicken/Nigeria/AB13/2006(H5N1)) mRNA for non-structural protein (ns gene) | 827 bp linear mRNA | AM503040.1 GI:147846316 |
| 47. Influenza A virus (A/chicken/Nigeria/AB13/2006(H5N1)) partial mRNA for polymerase (pa gene) | 2,169 bp linear mRNA | AM503051.1 GI:147846338 |
| 48. Influenza A virus (A/chicken/Nigeria/AB13/2006(H5N1)) partial mRNA for polymerase basic protein 1 (pb1 gene) | 2,259 bp linear mRNA | AM503060.1 GI:147846845 |
| 49. Influenza A virus (A/chicken/Nigeria/AB13/2006(H5N1)) partial mRNA for polymerase basic protein 2 (pb2 gene) | 2,315 bp linear mRNA | AM503071.1 GI:147846867 |
| 70. Influenza A virus (A/chicken/Hong Kong/3123.1/2002(H5N1)) neuraminidase (NA) mRNA, partial cds | 1,055 bp linear mRNA | DQ250158.1 GI:82412012 |
| 75. Influenza A virus (A/chicken/Krasnodar/01/2006(H5N1)) hemagglutinin (HA) mRNA, complete cds | 1,754 bp linear mRNA | DQ676834.1 GI:108782519 |

TABLE 9-continued

| Influenza H5N1 Antigens | | |
|---|---|---|
| Strain/Protein | Length | GenBank/GI Accession No. |
| 78. Influenza A virus (A/chicken/Krasnodar/01/2006(H5N1)) neuraminidase (NA) mRNA, complete cds | 1,373 bp linear mRNA | DQ676836.2 GI:115520953 |
| 91. Influenza A virus (A/chicken/Lobzenko/01/2008(H5N1)) hemagglutinin (HA) mRNA, partial cds | 184 bp linear mRNA | EU447276.1 GI:168998217 |
| 92. Influenza A virus (A/chicken/Mahachkala/05/2006(H5N1)) hemagglutinin (HA) mRNA, complete cds | 1,683 bp linear mRNA | DQ676830.1 GI:108782511 |
| 94. Influenza A virus (A/chicken/Mahachkala/05/2006(H5N1)) neuraminidase (NA) mRNA, complete cds | 1,373 bp linear mRNA | DQ676832.1 GI:108782515 |
| 96. Influenza A virus (A/chicken/Malaysia/01/2004(H5N1)) neuramidase (NA) mRNA, partial cds | 433 bp linear mRNA | DQ096567.1 GI:69145364 |
| 97. Influenza A virus (A/chicken/Nigeria/AB13/2006(H5N1)) partial mRNA for hemagglutinin (ha gene) | 1,722 bp linear mRNA | AM503002.1 GI:147846240 |
| 98. Influenza A virus (A/chicken/Nigeria/AB13/2006(H5N1)) partial mRNA for neuraminidase (na gene) | 1,329 bp linear mRNA | AM503020.1 GI:147846276 |
| 105. Influenza A virus (A/chicken/Nigeria/AB14/2006(H5N1)) partial mRNA for hemagglutinin (ha gene) | 1,719 bp linear mRNA | AM503003.1 GI:147846242 |
| 106. Influenza A virus (A/chicken/Nigeria/AB14/2006(H5N1)) partial mRNA for matrix protein 1 (m1 gene) | 953 bp linear mRNA | AM503011.1 GI:147846258 |
| 107. Influenza A virus (A/chicken/Nigeria/AB14/2006(H5N1)) partial mRNA for neuraminidase (na gene) | 1,343 bp linear mRNA | AM503025.1 GI:147846286 |
| 108. Influenza A virus (A/chicken/Nigeria/AB14/2006(H5N1)) mRNA for non-structural protein (ns gene) | 827 bp linear mRNA | AM503041.1 GI:147846318 |
| 109. Influenza A virus (A/chicken/Nigeria/AB14/2006(H5N1)) partial mRNA for polymerase (pa gene) | 2,169 bp linear mRNA | AM503054.1 GI:147846344 |
| 110. Influenza A virus (A/chicken/Nigeria/AB14/2006(H5N1)) partial mRNA for polymerase basic protein 1 (pb1 gene) | 2,259 bp linear mRNA | AM503061.1 GI:147846847 |
| 111. Influenza A virus (A/chicken/Nigeria/AB14/2006(H5N1)) partial mRNA for polymerase basic protein 2 (pb2 gene) | 2,315 bp linear mRNA | AM503072.1 GI:147846869 |
| 112. Influenza A virus (A/chicken/Nigeria/AB14/2006(H5N1)) mRNA for nucleoprotein (np gene) | 1,548 bp linear mRNA | AM503034.2 GI:149773117 |
| 113. Influenza A virus (A/chicken/Nigeria/BA210/2006(H5N1)) partial mRNA for neuraminidase (na gene) | 1,342 bp linear mRNA | AM503022.1 GI:147846280 |
| 114. Influenza A virus (A/chicken/Nigeria/BA211/2006(H5N1)) partial mRNA for neuraminidase (na gene) | 1,321 bp linear mRNA | AM503021.1 GI:147846278 |
| 115. Influenza A virus (A/chicken/Nigeria/BA211/2006(H5N1)) partial mRNA for polymerase basic protein 2 (pb2 gene) | 2,315 bp linear mRNA | AM503073.1 GI:147846871 |
| 116. Influenza A virus (A/chicken/Nigeria/FA4/2006(H5N1)) partial raRNA for hemagglutinin (ha gene) | 1,717 bp linear mRNA | AM503004.1 GI:147846244 |
| 117. Influenza A virus (A/chicken/Nigeria/FA4/2006(H5N1)) partial mRNA for matrix protein 1 (m1 gene) | 989 bp linear mRNA | AM503013.1 GI:147846262 |
| 118. Influenza A virus (A/chicken/Nigeria/FA4/2006(H5N1)) partial mRNA for neuraminidase (na gene) | 1,321 bp linear mRNA | AM503026.1 GI:147846288 |
| 119. Influenza A virus (A/chicken/Nigeria/FA4/2006(H5N1)) mRNA for non-structural protein (ns gene) | 827 bp linear mRNA | AM503045.1 GI:147846326 |
| 120. Influenza A virus (A/chicken/Nigeria/FA4/2006(H5N1)) partial mRNA for polymerase (pa gene) | 2,169 bp linear mRNA | AM503055.1 GI:147846346 |
| 121. Influenza A virus (A/chicken/Nigeria/FA4/2006(H5N1)) partial mRNA for polymerase basic protein 1 (pb1 gene) | 2,259 bp linear mRNA | AM503064.1 GI:147846853 |
| 122. Influenza A virus (A/chicken/Nigeria/FA4/2006(H5N1)) partial mRNA for polymerase basic protein 2 (pb2 gene) | 2,224 bp linear mRNA | AM503074.1 GI:147846873 |

TABLE 9-continued

| Influenza H5N1 Antigens | | |
|---|---|---|
| Strain/Protein | Length | GenBank/GI Accession No. |
| 123. Influenza A virus (A/chicken/Nigeria/FA6/2006(H5N1)) partial mRNA for hemagglutinin (ha gene) | 1,717 bp linear mRNA | AM502998.1 GI:147846232 |
| 124. Influenza A virus (A/chicken/Nigeria/FA6/2006(H5N1)) partial mRNA for matrix protein 1 (m1 gene) | 965 bp linear mRNA | AM503012.1 GI:147846260 |
| 125. Influenza A virus (A/chicken/Nigeria/FA6/2006(H5N1)) partial mRNA for neuraminidase (na gene) | 1,327 bp linear mRNA | AM503023.1 GI:147846282 |
| 126. Influenza A virus (A/chicken/Nigeria/FA6/2006(H5N1)) mRNA for nucleoprotein (np gene) | 1,543 bp linear mRNA | AM503031.1 GI:147846298 |
| 127. Influenza A virus (A/chicken/Nigeria/FA6/2006(H5N1)) partial mRNA for polymerase (pa gene) | 2,169 bp linear mRNA | AM503052.1 GI:147846340 |
| 128. Influenza A virus (A/chicken/Nigeria/FA6/2006(H5N1)) partial mRNA for polymerase basic protein 1 (pb1 gene) | 2,259 bp linear mRNA | AM503063.1 GI:147846851 |
| 129. Influenza A virus (A/chicken/Nigeria/FA7/2006(H5N1)) partial mRNA for hemagglutinin (ha gene) | 1,710 bp linear mRNA | AM502999.1 GI:147846234 |
| 130. Influenza A virus (A/chicken/Nigeria/FA7/2006(H5N1)) partial mRNA for matrix protein 1 (m1 gene) | 1,001 bp linear mRNA | AM503009.1 GI:147846254 |
| 131. Influenza A virus (A/chicken/Nigeria/FA7/2006(H5N1)) partial mRNA for neuraminidase (na gene) | 1,331 bp linear mRNA | AM503018.1 GI:147846272 |
| 132. Influenza A virus (A/chicken/Nigeria/FA7/2006(H5N1)) mRNA for nucleoprotein (np gene) | 1,531 bp linear mRNA | AM503035.1 GI:147846306 |
| 133. Influenza A virus (A/chicken/Nigeria/FA7/2006(H5N1)) mRNA for non-structural protein (ns gene) | 827 bp linear mRNA | AM503042.1 GI:147846320 |
| 134. Influenza A virus (A/chicken/Nigeria/FA7/2006(H5N1)) partial mRNA for polymerase (pa gene) | 2,169 bp linear mRNA | AM503049.1 GI:147846334 |
| 135. Influenza A virus (A/chicken/Nigeria/FA7/2006(H5N1)) partial raRNA for polymerase basic protein 1 (pb1 gene) | 2,259 bp linear mRNA | AM503057.1 GI:147846350 |
| 136. Influenza A virus (A/chicken/Nigeria/FA7/2006(H5N1)) partial mRNA for polymerase basic protein 2 (pb2 gene) | 2,315 bp linear mRNA | AM503068.1 GI:147846861 |
| 137. Influenza A virus (A/chicken/Nigeria/IF10/2006(H5N1)) partial mRNA for hemagglutinin (ha gene) | 1,714 bp linear mRNA | AM503001.1 GI:147846238 |
| 138. Influenza A virus (A/chicken/Nigeria/IF10/2006(H5N1)) partial mRNA for matrix protein 1 (m1 gene) | 990 bp linear mRNA | AM503010.1 GI:147846256 |
| 139. Influenza A virus (A/chicken/Nigeria/IF10/2006(H5N1)) partial mRNA for neuraminidase (na gene) | 1,332 bp linear mRNA | AM503024.1 GI:147846284 |
| 140. Influenza A virus (A/chicken/Nigeria/IF10/2006(H5N1)) mRNA for non-structural protein (ns gene) | 827 bp linear mRNA | AM503044.1 GI:147846324 |
| 141. Influenza A virus (A/chicken/Nigeria/IF10/2006(H5N1)) partial mRNA for polymerase (pa gene) | 2,169 bp linear mRNA | AM503053.1 GI:147846342 |
| 142. Influenza A virus (A/chicken/Nigeria/IF10/2006(H5N1)) partial mRNA for polymerase basic protein 1 (pb1 gene) | 2,259 bp linear mRNA | AM503059.1 GI:147846843 |
| 143. Influenza A virus (A/chicken/Nigeria/IF10/2006(H5N1)) partial mRNA for polymerase basic protein 2 (pb2 gene) | 2,315 bp linear mRNA | AM503069.1 GI:147846863 |
| 144. Influenza A virus (A/chicken/Nigeria/IF10/2006(H5N1)) mRNA for nucleoprotein (np gene) | 1,550 bp linear mRNA | AM503033.2 GI:149773115 |
| 145. Influenza A virus (A/chicken/Nigeria/OD8/2006(H5N1)) partial mRNA for hemagglutinin (ha gene) | 1,719 bp linear mRNA | AM503005.1 GI:147846246 |
| 146. Influenza A virus (A/chicken/Nigeria/OD8/2006(H5N1)) partial mRNA for matrix protein 1 (m1 gene) | 989 bp linear mRNA | AM503014.1 GI:147846264 |
| 147. Influenza A virus (A/chicken/Nigeria/OD9/2006(H5N1)) partial mRNA for hemagglutinin (ha gene) | 1,720 bp linear mRNA | AM503000.1 GI:147846236 |

TABLE 9-continued

| Influenza H5N1 Antigens | | |
|---|---|---|
| Strain/Protein | Length | GenBank/GI Accession No. |
| 148. Influenza A virus (A/chicken/Nigeria/OD9/2006(H5N1)) partial mRNA for matrix protein 1 (m1 gene) | 988 bp linear mRNA | AM503015.1 GI:147846266 |
| 149. Influenza A virus (A/chicken/Nigeria/OD9/2006(H5N1)) partial mRNA for neuraminidase (na gene) | 1,330 bp linear mRNA | AM503019.1 GI:147846274 |
| 150. Influenza A virus (A/chicken/Nigeria/OD9/2006(H5N1)) mRNA for nucleoprotein (np gene) | 1,531 bp linear mRNA | AM503032.1 GI:147846300 |
| 151. Influenza A virus (A/chicken/Nigeria/OD9/2006(H5N1)) mRNA for non-structural protein (ns gene) | 827 bp linear mRNA | AM503043.1 GI:147846322 |
| 152. Influenza A virus (A/chicken/Nigeria/OD9/2006(H5N1)) partial mRNA for polymerase (pa gene) | 2,169 bp linear mRNA | AM503050.1 GI:147846336 |
| 153. Influenza A virus (A/chicken/Nigeria/OD9/2006(H5N1)) partial raRNA for polymerase basic protein 1 (pb1 gene) | 2,259 bp linear mRNA | AM503058.1 GI:147846841 |
| 154. Influenza A virus (A/chicken/Nigeria/OD9/2006(H5N1)) partial mRNA for polymerase basic protein 2 (pb2 gene) | 2,315 bp linear mRNA | AM503070.1 GI:147846865 |
| 155. Influenza A virus (A/chicken/Scotland/59(H5N1)) mRNA for haemagglutinin precursor | 1,768 bp linear mRNA | X07869.1 GI:60482 |
| 156. Influenza A virus (A/chicken/Scotland/59(H5N1)) N1 gene for neuraminidase, genomic RNA | 1,445 bp linear mRNA | AJ416625.1 GI:39840717 |
| 161. Influenza A virus (A/chicken/zz/02/2004(H5N1)) nucleoprotein mRNA, complete cds | 1,497 bp linear mRNA | DQ208502.1 GI:77158587 |
| 162. Influenza A virus (A/common coot/Switzerland/V544/2006(H5N1)) hemagglutinin (HA) gene, complete cds | 1,707 bp linear mRNA | EF110519.1 GI:119394676 |
| 163. Influenza A virus (A/domestic goose/Pavlodar/1/2005(H5N1)) hemagglutinin (HA) mRNA, complete cds | 1,735 bp linear mRNA | EU190482.1 GI:158516739 |
| 164. Influenza A virus (A/duck/Eastern China/145/2003(H5N1)) segment 6 neuraminidase (NA) mRNA, complete cds | 1,401 bp linear mRNA | EU429750.1 GI:167859465 |
| 165. Influenza A virus (A/duck/Eastern China/150/2003(H5N1)) segment 6 neuraminidase (NA) mRNA, complete cds | 1,407 bp linear mRNA | EU429731.1 GI:167859427 |
| 166. Influenza A virus (A/duck/Eastern China/22/2005(H5N1)) segment 6 neuraminidase (NA) mRNA, complete cds | 1,398 bp linear mRNA | EU429783.1 GI:167859531 |
| 167. Influenza A virus (A/duck/Eastern China/304/2002(H5N1)) segment 6 neuraminidase (NA) mRNA, complete cds | 1,398 bp linear mRNA | EU429747.1 GI:167859459 |
| 168. Influenza A virus (A/duck/Eastern China/318/2002(H5N1)) segment 6 neuraminidase (NA) mRNA, complete cds | 1,401 bp linear mRNA | EU429727.1 GI:167859419 |
| 169. Influenza A virus (A/duck/Eastern China/37/2006(H5N1)) segment 6 neuraminidase (NA) mRNA, complete cds | 1,399 bp linear mRNA | EU429778.1 GI:167859521 |
| 170. Influenza A virus (A/duck/Eastern China/40/2005(H5N1)) segment 6 neuraminidase (NA) mRNA, complete cds | 1,398 bp linear mRNA | EU429757.1 GI:167859479 |
| 171. Influenza A virus (A/duck/Eastern China/48/2006(H5N1)) segment 6 neuraminidase (NA) mRNA, complete cds | 1,398 bp linear mRNA | EU429779.1 GI:167859523 |
| 172. Influenza A virus (A/duck/Eastern China/51/2005(H5N1)) segment 6 neuraminidase (NA) mRNA, complete cds | 1,398 bp linear mRNA | EU429763.1 GI:167859491 |
| 173. Influenza A virus (A/duck/Eastern China/54/2005(H5N1)) segment 6 neuraminidase (NA) mRNA, complete cds | 1,398 bp linear mRNA | EU429758.1 GI:167859481 |
| 174. Influenza A virus (A/duck/Eastern China/58/2005(H5N1)) segment 6 neuraminidase (NA) mRNA, complete cds | 1,398 bp linear mRNA | EU429764.1 GI:167859493 |
| 175. Influenza A virus (A/duck/Eastern China/59/2005(H5N1)) segment 6 neuraminidase (NA) mRNA, complete cds | 1,398 bp linear mRNA | EU429759.1 GI:167859483 |
| 176. Influenza A virus (A/duck/Eastern China/89/2005(H5N1)) segment 6 neuraminidase (NA) mRNA, complete cds | 1,398 bp linear mRNA | EU429765.1 GI:167859495 |

TABLE 9-continued

| Influenza H5N1 Antigens | | |
|---|---|---|
| Strain/Protein | Length | GenBank/GI Accession No. |
| 177. Influenza A virus (A/duck/Eastern China/89/2006(H5N1)) segment 6 neuraminidase (NA) mRNA, complete cds | 1,399 bp linear mRNA | EU429785.1 GI:167859535 |
| 178. Influenza A virus (A/duck/Eastern China/97/2001(H5N1)) segment 6 neuraminidase (NA) mRNA, complete cds | 1,398 bp linear mRNA | EU429717.1 GI:167859399 |
| 179. Influenza A virus (A/duck/Fujian/01/2002(H5N1)) polymerase basic protein 2 (PB2) mRNA, complete cds | 2,281 bp linear mRNA | AY585504.1 GI:47156226 |
| 180. Influenza A virus (A/duck/Fujian/01/2002(H5N1)) matrix protein mRNA, complete cds | 760 bp linear mRNA | AY585378.1 GI:47156310 |
| 181. Influenza A virus (A/duck/Fujian/01/2002(H5N1)) neuraminidase (NA) mRNA, complete cds | 1,357 bp linear mRNA | AY585399.1 GI:47156352 |
| 182. Influenza A virus (A/duck/Fujian/01/2002(H5N1)) nucleoprotein (NP) mRNA, complete cds | 1,497 bp linear mRNA | AY585420.1 GI:47156394 |
| 183. Influenza A virus (A/duck/Fujian/01/2002(H5N1)) nonstructural protein 1 (NS1) mRNA, partial cds | 686 bp linear mRNA | AY585441.1 GI:47156436 |
| 184. Influenza A virus (A/duck/Fujian/13/2002(H5N1)) polymerase basic protein 2 (PB2) mRNA, complete cds | 2,281 bp linear mRNA | AY585505.1 GI:47156228 |
| 185. Influenza A virus (A/duck/Fujian/13/2002(H5N1)) matrix protein mRNA, complete cds | 761 bp linear mRNA | AY585379.1 GI:47156312 |
| 186. Influenza A virus (A/duck/Fujian/13/2002(H5N1)) neuraminidase (NA) mRNA, complete cds | 1,357 bp linear mRNA | AY585400.1 GI:47156354 |
| 187. Influenza A virus (A/duck/Fujian/13/2002(H5N1)) nucleoprotein (NP) mRNA, complete cds | 1,499 bp linear mRNA | AY585421.1 GI:47156396 |
| 188. Influenza A virus (A/duck/Fujian/13/2002(H5N1)) nonstructural protein 1 (NS1) mRNA, partial cds | 685 bp linear mRNA | AY585442.1 GI:47156438 |
| 189. Influenza A virus (A/duck/Fujian/17/2001(H5N1)) polymerase basic protein 2 (PB2) mRNA, complete cds | 2,281 bp linear mRNA | AY585506.1 GI:47156230 |
| 190. Influenza A virus (A/duck/Fujian/17/2001(H5N1)) matrix protein mRNA, complete cds | 759 bp linear mRNA | AY585380.1 GI:47156314 |
| 191. Influenza A virus (A/duck/Fujian/17/2001(H5N1)) neuraminidase (NA) mRNA, complete cds | 1,418 bp linear mRNA | AY585401.1 GI:47156356 |
| 192. Influenza A virus (A/duck/Fujian/17/2001(H5N1)) nucleoprotein (NP) mRNA, complete cds | 1,498 bp linear mRNA | AY585422.1 GI:47156398 |
| 193. Influenza A virus (A/duck/Fujian/17/2001(H5N1)) nonstructural protein 1 (NS1) mRNA, complete cds | 686 bp linear mRNA | AY585443.1 GI:47156440 |
| 194. Influenza A virus (A/duck/Fujian/19/2000(H5N1)) polymerase basic protein 2 (PB2) mRNA, complete cds | 2,281 bp linear mRNA | AY585507.1 GI:47156232 |
| 195. Influenza A virus (A/duck/Fujian/19/2000(H5N1)) matrix protein mRNA, complete cds | 760 bp linear mRNA | AY585381.1 GI:47156316 |
| 196. Influenza A virus (A/duck/Fujian/19/2000(H5N1)) neuraminidase (NA) mRNA, complete cds | 1,355 bp linear mRNA | AY585402.1 GI:47156358 |
| 197. Influenza A virus (A/duck/Fujian/19/2000(H5N1)) nucleoprotein (NP) mRNA, complete cds | 1,498 bp linear mRNA | AY585423.1 GI:47156400 |
| 198. Influenza A virus (A/duck/Fujian/19/2000(H5N1)) nonstructural protein 1 (NS1) mRNA, complete cds | 687 bp linear mRNA | AY585444.1 GI:47156442 |
| 199. Influenza A virus (A/duck/Guangdong/01/2001(H5N1)) polymerase basic protein 2 (PB2) mRNA, complete cds | 2,281 bp linear mRNA | AY585508.1 GI:47156234 |
| 200. Influenza A virus (A/duck/Guangdong/01/2001(H5N1)) matrix protein mRNA, complete cds | 760 bp linear mRNA | AY585382.1 GI:47156318 |
| 201. Influenza A virus (A/duck/Guangdong/01/2001(H5N1)) neuraminidase (NA) mRNA, complete cds | 1,414 bp linear mRNA | AY585403.1 GI:47156360 |

TABLE 9-continued

| Influenza H5N1 Antigens | | |
|---|---|---|
| Strain/Protein | Length | GenBank/GI Accession No. |
| 202. Influenza A virus (A/duck/Guangdong/01/2001(H5N1)) nucleoprotein (NP) mRNA, complete cds | 1,497 bp linear mRNA | AY585424.1 GI:47156402 |
| 203. Influenza A virus (A/duck/Guangdong/01/2001(H5N1)) nonstructural protein 1 (NS1) mRNA, complete cds | 687 bp linear mRNA | AY585445.1 GI:47156444 |
| 204. Influenza A virus (A/duck/Guangdong/07/2000(H5N1)) polymerase basic protein 2 (PB2) mRNA, complete cds | 2,280 bp linear mRNA | AY585509.1 GI:47156236 |
| 205. Influenza A virus (A/duck/Guangdong/07/2000(H5N1)) matrix protein mRNA, complete cds | 759 bp linear mRNA | AY585383.1 GI:47156320 |
| 206. Influenza A virus (A/duck/Guangdong/07/2000(H5N1)) neuraminidase (NA) mRNA, complete cds | 1,417 bp linear mRNA | AY585404.1 GI:47156362 |
| 207. Influenza A virus (A/duck/Guangdong/07/2000(H5N1)) nucleoprotein (NP) mRNA, complete cds | 1,497 bp linear mRNA | AY585425.1 GI:47156404 |
| 208. Influenza A virus (A/duck/Guangdong/07/2000(H5N1)) nonstructural protein 1 (NS1) mRNA, partial cds | 690 bp linear mRNA | AY585446.1 GI:47156446 |
| 209. Influenza A virus (A/duck/Guangdong/12/2000(H5N1)) polymerase basic protein 2 (PB2) mRNA, complete cds | 2,281 bp linear mRNA | AY585510.1 GI:47156238 |
| 210. Influenza A virus (A/duck/Guangdong/12/2000(H5N1)) matrix protein mRNA, complete cds | 760 bp linear mRNA | AY585384.1 GI:47156322 |
| 211. Influenza A virus (A/duck/Guangdong/12/2000(H5N1)) neuraminidase (NA) mRNA, complete cds | 1,359 bp linear mRNA | AY585405.1 GI:47156364 |
| 212. Influenza A virus (A/duck/Guangdong/12/2000(H5N1)) nucleoprotein (NP) mRNA, complete cds | 1,498 bp linear mRNA | AY585426.1 GI:47156406 |
| 213. Influenza A virus (A/duck/Guangdong/12/2000(H5N1)) nonstructural protein 1 (NS1) mRNA, partial cds | 685 bp linear mRNA | AY585447.1 GI:47156448 |
| 214. Influenza A virus (A/duck/Guangdong/22/2002(H5N1)) polymerase basic protein 2 (PB2) mRNA, complete cds | 2,281 bp linear mRNA | AY585511.1 GI:47156240 |
| 215. Influenza A virus (A/duck/Guangdong/22/2002(H5N1)) matrix protein mRNA, complete cds | 760 bp linear mRNA | AY585385.1 GI:47156324 |
| 216. Influenza A virus (A/duck/Guangdong/22/2002(H5N1)) neuraminidase (NA) mRNA, complete cds | 1,412 bp linear mRNA | AY585406.1 GI:47156366 |
| 217. Influenza A virus (A/duck/Guangdong/22/2002(H5N1)) nucleoprotein (NP) mRNA, complete cds | 1,499 bp linear mRNA | AY585427.1 GI:47156408 |
| 218. Influenza A virus (A/duck/Guangdong/22/2002(H5N1)) nonstructural protein 1 (NS1) mRNA, complete cds | 682 bp linear mRNA | AY585448.1 GI:47156450 |
| 219. Influenza A virus (A/duck/Guangdong/40/2000(H5N1)) polymerase basic protein 2 (PB2) mRNA, complete cds | 2,281 bp linear mRNA | AY585512.1 GI:47156242 |
| 220. Influenza A virus (A/duck/Guangdong/40/2000(H5N1)) matrix protein mRNA, complete cds | 760 bp linear mRNA | AY585386.1 GI:47156326 |
| 221. Influenza A virus (A/duck/Guangdong/40/2000(H5N1)) neuraminidase (NA) mRNA, partial cds | 1,401 bp linear mRNA | AY585407.1 GI:47156368 |
| 222. Influenza A virus (A/duck/Guangdong/40/2000(H5N1)) nucleoprotein (NP) mRNA, complete cds | 1,499 bp linear mRNA | AY585428.1 GI:47156410 |
| 223. Influenza A virus (A/duck/Guangdong/40/2000(H5N1)) nonstructural protein 1 (NS1) mRNA, partial cds | 689 bp linear mRNA | AY585449.1 GI:47156452 |
| 224. Influenza A virus (A/duck/Guangxi/07/1999(H5N1)) polymerase basic protein 2 (PB2) mRNA, complete cds | 2,281 bp linear mRNA | AY585513.1 GI:47156244 |
| 225. Influenza A virus (A/duck/Guangxi/07/1999(H5N1)) matrix protein mRNA, complete cds | 760 bp linear mRNA | AY585387.1 GI:47156328 |
| 226. Influenza A virus (A/duck/Guangxi/07/1999(H5N1)) neuraminidase (NA) mRNA, complete cds | 1,421 bp linear mRNA | AY585408.1 GI:47156370 |

TABLE 9-continued

| Influenza H5N1 Antigens | | |
|---|---|---|
| Strain/Protein | Length | GenBank/GI Accession No. |
| 227. Influenza A virus (A/duck/Guangxi/07/1999(H5N1)) nucleoprotein (NP) mRNA, complete cds | 1,501 bp linear mRNA | AY585429.1 GI:47156412 |
| 228. Influenza A virus (A/duck/Guangxi/07/1999(H5N1)) nonstructural protein 1 (NS1) mRNA, partial cds | 687 bp linear mRNA | AY585450.1 GI:47156454 |
| 229. Influenza A virus (A/duck/Guangxi/13/2004(H5N1)) nonstructural protein 1 mRNA, complete cds | 875 bp linear mRNA | DQ366342.1 GI:86753723 |
| 230. Influenza A virus (A/duck/Guangxi/13/2004(H5N1)) polymerase PB2 mRNA, complete cds | 2,341 bp linear mRNA | DQ366335.1 GI:86753733 |
| 231. Influenza A virus (A/duck/Guangxi/13/2004(H5N1)) polymerase PB1 mRNA, complete cds | 2,341 bp linear mRNA | DQ366336.1 GI:86753743 |
| 232. Influenza A virus (A/duck/Guangxi/13/2004(H5N1)) PA protein mRNA, complete cds | 2,233 bp linear mRNA | DQ366337.1 GI:86753753 |
| 233. Influenza A virus (A/duck/Guangxi/13/2004(H5N1)) hemagglutinin mRNA, complete cds | 1,776 bp linear mRNA | DQ366338.1 GI:86753763 |
| 234. Influenza A virus (A/duck/Guangxi/13/2004(H5N1)) nucleocapsid mRNA, complete cds | 1,565 bp linear mRNA | DQ366339.1 GI:86753773 |
| 235. Influenza A virus (A/duck/Guangxi/13/2004(H5N1)) neuraminidase mRNA, complete cds | 1,378 bp linear mRNA | DQ366340.1 GI:86753783 |
| 236. Influenza A virus (A/duck/Guangxi/13/2004(H5N1)) matrix protein mRNA, complete cds | 1,027 bp linear mRNA | DQ366341.1 GI:86753793 |
| 237. Influenza A virus (A/duck/Guangxi/22/2001(H5N1)) polymerase basic protein 2 (PB2) mRNA, complete cds | 2,281 bp linear mRNA | AY585514.1 GI:47156246 |
| 238. Influenza A virus (A/duck/Guangxi/22/2001(H5N1)) matrix protein mRNA, partial cds | 757 bp linear mRNA | AY585388.1 GI:47156330 |
| 239. Influenza A virus (A/duck/Guangxi/22/2001(H5N1)) neuraminidase (NA) mRNA, complete cds | 1,414 bp linear mRNA | AY585409.1 GI:47156372 |
| 240. Influenza A virus (A/duck/Guangxi/22/2001(H5N1)) nucleoprotein (NP) mRNA, complete cds | 1,498 bp linear mRNA | AY585430.1 GI:47156414 |
| 241. Influenza A virus (A/duck/Guangxi/22/2001(H5N1)) nonstructural protein 1 (NS1) mRNA, complete cds | 687 bp linear mRNA | AY585451.1 GI:47156456 |
| 242. Influenza A virus (A/duck/Guangxi/35/2001(H5N1)) polymerase basic protein 2 (PB2) mRNA, complete cds | 2,281 bp linear mRNA | AY585515.1 GI:47156248 |
| 243. Influenza A virus (A/duck/Guangxi/35/2001(H5N1)) matrix protein mRNA, complete cds | 760 bp linear mRNA | AY585389.1 GI:47156332 |
| 244. Influenza A virus (A/duck/Guangxi/35/2001(H5N1)) neuraminidase (NA) mRNA, complete cds | 1,414 bp linear mRNA | AY585410.1 GI:47156374 |
| 245. Influenza A virus (A/duck/Guangxi/35/2001(H5N1)) nucleoprotein (NP) mRNA, complete cds | 1,498 bp linear mRNA | AY585431.1 GI:47156416 |
| 246. Influenza A virus (A/duck/Guangxi/35/2001(H5N1)) nonstructural protein 1 (NS1) mRNA, complete cds | 685 bp linear mRNA | AY585452.1 GI:47156458 |
| 247. Influenza A virus (A/duck/Guangxi/50/2001(H5N1)) polymerase basic protein 2 (PB2) mRNA, complete cds | 2,281 bp linear mRNA | AY585516.1 GI:47156250 |
| 248. Influenza A virus (A/duck/Guangxi/50/2001(H5N1)) matrix protein mRNA, complete cds | 760 bp linear mRNA | AY585398.1 GI:47156350 |
| 249. Influenza A virus (A/duck/Guangxi/50/2001(H5N1)) neuraminidase (NA) mRNA, complete cds | 1,354 bp linear mRNA | AY585411.1 GI:47156376 |
| 250. Influenza A virus (A/duck/Guangxi/50/2001(H5N1)) nucleoprotein (NP) mRNA, complete cds | 1,498 bp linear mRNA | AY585432.1 GI:47156418 |
| 251. Influenza A virus (A/duck/Guangxi/50/2001(H5N1)) nonstructural protein 1 (NS1) mRNA, complete cds | 686 bp linear mRNA | AY585453.1 GI:47156460 |

TABLE 9-continued

| Influenza H5N1 Antigens | | |
|---|---|---|
| Strain/Protein | Length | GenBank/GI Accession No. |
| 252. Influenza A virus (A/duck/Guangxi/53/2002(H5N1)) polymerase basic protein 2 (PB2) mRNA, complete cds | 2,281 bp linear mRNA | AY585517.1 GI:47156252 |
| 253. Influenza A virus (A/duck/Guangxi/53/2002(H5N1)) matrix protein mRNA, complete cds | 760 bp linear mRNA | AY585390.1 GI:47156334 |
| 254. Influenza A virus (A/duck/Guangxi/53/2002(H5N1)) neuraminidase (NA) mRNA, complete cds | 1,361 bp linear mRNA | AY585412.1 GI:47156378 |
| 255. Influenza A virus (A/duck/Guangxi/53/2002(H5N1)) nucleoprotein (NP) mRNA, complete cds | 1,498 bp linear mRNA | AY585433.1 GI:47156420 |
| 256. Influenza A virus (A/duck/Guangxi/53/2002(H5N1)) nonstructural protein 1 (NS1) mRNA, partial cds | 687 bp linear mRNA | AY585454.1 GI:47156462 |
| 257. Influenza A virus (A/duck/Kurgan/08/2005(H5N1)) hemagglutinin (HA) mRNA, complete cds | 1,754 bp linear mRNA | DQ449640.1 GI:90289674 |
| 258. Influenza A virus (A/duck/Kurgan/08/2005(H5N1)) matrix protein 1 (M) mRNA, complete cds | 1,002 bp linear mRNA | DQ449641.1 GI:90289689 |
| 259. Influenza A virus (A/duck/Kurgan/08/2005(H5N1)) neuraminidase (NA) mRNA, complete cds | 1,373 bp linear mRNA | DQ449642.1 GI:90289708 |
| 260. Influenza A virus (A/duck/Kurgan/08/2005(H5N1)) nucleoprotein (NP) mRNA, complete cds | 1,540 bp linear mRNA | DQ449643.1 GI:90289731 |
| 261. Influenza A virus (A/duck/Kurgan/08/2005(H5N1)) nonstructural protein (NS) mRNA, complete cds | 850 bp linear mRNA | DQ449644.1 GI:90289739 |
| 262. Influenza A virus (A/duck/Kurgan/08/2005(H5N1)) polymerase acidic protein (PA) mRNA, complete cds | 2,208 bp linear mRNA | DQ449645.1 GI:90289756 |
| 263. Influenza A virus (A/duck/Kurgan/08/2005(H5N1)) polymerase basic protein 1 (PB1) mRNA, complete cds | 2,316 bp linear mRNA | DQ449646.1 GI:90289774 |
| 264. Influenza A virus (A/duck/Kurgan/08/2005(H5N1)) polymerase basic protein 2 (PB2) mRNA, complete cds | 2,316 bp linear mRNA | DQ449647.1 GI:90289783 |
| 266. Influenza A virus (A/duck/Shanghai/08/2001(H5N1)) polymerase basic protein 2 (PB2) mRNA, complete cds | 2,281 bp linear mRNA | AY585518.1 GI:47156254 |
| 267. Influenza A virus (A/duck/Shanghai/08/2001(H5N1)) matrix protein mRNA, complete cds | 760 bp linear mRNA | AY585391.1 GI:47156336 |
| 268. Influenza A virus (A/duck/Shanghai/08/2001(H5N1)) neuraminidase (NA) mRNA, complete cds | 1,357 bp linear mRNA | AY585413.1 GI:47156380 |
| 269. Influenza A virus (A/duck/Shanghai/08/2001(H5N1)) nucleoprotein (NP) mRNA, complete cds | 1,498 bp linear mRNA | AY585434.1 GI:47156422 |
| 270. Influenza A virus (A/duck/Shanghai/08/2001(H5N1)) nonstructural protein 1 (NS1) mRNA, partial cds | 685 bp linear mRNA | AY585455.1 GI:47156464 |
| 271. Influenza A virus (A/duck/Shanghai/13/2001(H5N1)) polymerase basic protein 2 (PB2) mRNA, complete cds | 2,281 bp linear mRNA | AY585519.1 GI:47156256 |
| 272. Influenza A virus (A/duck/Shanghai/13/2001(H5N1)) matrix protein mRNA, complete cds | 760 bp linear mRNA | AY585392.1 GI:47156338 |
| 273. Influenza A virus (A/duck/Shanghai/13/2001(H5N1)) neuraminidase (NA) mRNA, complete cds | 1,417 bp linear mRNA | AY585414.1 GI:47156382 |
| 274. Influenza A virus (A/duck/Shanghai/13/2001(H5N1)) nucleoprotein (NP) mRNA, complete cds | 1,499 bp linear mRNA | AY585435.1 GI:47156424 |
| 275. Influenza A virus (A/duck/Shanghai/13/2001(H5N1)) nonstructural protein 1 (NS1) mRNA, complete cds | 685 bp linear mRNA | AY585456.1 GI:47156466 |
| 276. Influenza A virus (A/duck/Shanghai/35/2002(H5N1)) polymerase basic protein 2 (PB2) mRNA, complete cds | 2,281 bp linear mRNA | AY585520.1 GI:47156258 |
| 277. Influenza A virus (A/duck/Shanghai/35/2002(H5N1)) matrix protein mRNA, complete cds | 760 bp linear mRNA | AY585393.1 GI:47156340 |

TABLE 9-continued

| Influenza H5N1 Antigens | | |
|---|---|---|
| Strain/Protein | Length | GenBank/GI Accession No. |
| 278. Influenza A virus (A/duck/Shanghai/35/2002(H5N1)) neuraminidase (NA) mRNA, complete cds | 1,363 bp linear mRNA | AY585415.1 GI:47156384 |
| 279. Influenza A virus (A/duck/Shanghai/35/2002(H5N1)) nucleoprotein (NP) mRNA, complete cds | 1,498 bp linear mRNA | AY585436.1 GI:47156426 |
| 280. Influenza A virus (A/duck/Shanghai/35/2002(H5N1)) nonstructural protein 1 (NS1) mRNA, partial cds | 685 bp linear mRNA | AY585457.1 GI:47156468 |
| 281. Influenza A virus (A/duck/Shanghai/37/2002(H5N1)) polymerase basic protein 2 (PB2) mRNA, complete cds | 2,281 bp linear mRNA | AY585521.1 GI:47156260 |
| 282. Influenza A virus (A/duck/Shanghai/37/2002(H5N1)) matrix protein mRNA, complete cds | 760 bp linear mRNA | AY585394.1 GI:47156342 |
| 283. Influenza A virus (A/duck/Shanghai/37/2002(H5N1)) neuraminidase (NA) mRNA, complete cds | 1,361 bp linear mRNA | AY585416.1 GI:47156386 |
| 284. Influenza A virus (A/duck/Shanghai/37/2002(H5N1)) nucleoprotein (NP) mRNA, complete cds | 1,497 bp linear mRNA | AY585437.1 GI:47156428 |
| 285. Influenza A virus (A/duck/Shanghai/37/2002(H5N1)) nonstructural protein 1 (NS1) mRNA, partial cds | 685 bp linear mRNA | AY585458.1 GI:47156470 |
| 286. Influenza A virus (A/duck/Shanghai/38/2001(H5N1)) polymerase basic protein 2 (PB2) mRNA, complete cds | 2,282 bp linear mRNA | AY585522.1 GI:47156262 |
| 287. Influenza A virus (A/duck/Shanghai/38/2001(H5N1)) matrix protein mRNA, complete cds | 760 bp linear mRNA | AY585395.1 GI:47156344 |
| 288. Influenza A virus (A/duck/Shanghai/38/2001(H5N1)) neuraminidase (NA) mRNA, complete cds | 1,355 bp linear mRNA | AY585417.1 GI:47156388 |
| 289. Influenza A virus (A/duck/Shanghai/38/2001(H5N1)) nucleoprotein (NP) mRNA, complete cds | 1,499 bp linear mRNA | AY585438.1 GI:47156430 |
| 290. Influenza A virus (A/duck/Shanghai/38/2001(H5N1)) nonstructural protein 1 (NS1) mRNA, partial cds | 692 bp linear mRNA | AY585459.1 GI:47156472 |
| 291. Influenza A virus (A/duck/Sheyang/1/2005(H5N1)) nonstructural protein (NS) mRNA, complete cds | 875 bp linear mRNA | DQ354059.1 GI:87128643 |
| 292. Influenza A virus (A/duck/Tuva/01/2006(H5N1)) hemagglutinin (HA) mRNA, complete cds | 1,748 bp linear mRNA | DQ861291.1 GI:112820195 |
| 293. Influenza A virus (A/duck/Tuva/01/2006(H5N1)) matrix protein 1 (M1) mRNA, complete cds | 991 bp linear mRNA | DQ861292.1 GI:112820197 |
| 294. Influenza A virus (A/duck/Tuva/01/2006(H5N1)) neuraminidase (NA) mRNA, complete cds | 1,364 bp linear mRNA | DQ861293.1 GI:112820199 |
| 295. Influenza A virus (A/duck/Tuva/01/2006(H5N1)) nucleoprotein (NP) mRNA, complete cds | 1,531 bp linear mRNA | DQ861294.1 GI:112820201 |
| 296. Influenza A virus (A/duck/Tuva/01/2006(H5N1)) nonstructural protein (NS) mRNA, complete cds | 842 bp linear mRNA | DQ861295.1 GI:112820203 |
| 297. Influenza A virus (A/duck/Vietnam/1/2005(H5N1)) nonstructural protein 1 mRNA, complete cds | 890 bp linear mRNA | DQ366310.1 GI:86753715 |
| 298. Influenza A virus (A/duck/Vietnam/1/2005(H5N1)) polymerase PB2 mRNA, complete cds | 2,341 bp linear mRNA | DQ366303.1 GI:86753725 |
| 299. Influenza A virus (A/duck/Vietnam/1/2005(H5N1)) polymerase PB1 mRNA, complete cds | 2,341 bp linear mRNA | DQ366304.1 GI:86753735 |
| 300. Influenza A virus (A/duck/Vietnam/1/2005(H5N1)) PA protein mRNA, complete cds | 2,233 bp linear mRNA | DQ366305.1 GI:86753745 |
| 301. Influenza A virus (A/duck/Vietnam/1/2005(H5N1)) hemagglutinin mRNA, complete cds | 1,779 bp linear mRNA | DQ366306.1 GI:86753755 |
| 302. Influenza A virus (A/duck/Vietnam/1/2005(H5N1)) nucleocapsid mRNA, complete cds | 1,565 bp linear mRNA | DQ366307.1 GI:86753765 |

TABLE 9-continued

| Influenza H5N1 Antigens | | |
|---|---|---|
| Strain/Protein | Length | GenBank/GI Accession No. |
| 303. Influenza A virus (A/duck/Vietnam/1/2005(H5N1)) neuraminidase mRNA, complete cds | 1,401 bp linear mRNA | DQ366308.1 GI:86753775 |
| 304. Influenza A virus (A/duck/Vietnam/1/2005(H5N1)) matrix protein mRNA, complete cds | 1,027 bp linear mRNA | DQ366309.1 GI:86753785 |
| 305. Influenza A virus (A/duck/Vietnam/8/05(H5N1)) nonstructural protein 1 mRNA, complete cds | 890 bp linear mRNA | DQ366326.1 GI:86753719 |
| 306. Influenza A virus (A/duck/Vietnam/8/05(H5N1)) polymerase PB2 mRNA, complete cds | 2,341 bp linear mRNA | DQ366319.1 GI:86753729 |
| 307. Influenza A virus (A/duck/Vietnam/8/05(H5N1)) polymerase PB1 mRNA, complete cds | 2,341 bp linear mRNA | DQ366320.1 GI:86753739 |
| 308. Influenza A virus (A/duck/Vietnam/8/05(H5N1)) PA protein mRNA, complete cds | 2,233 bp linear mRNA | DQ366321.1 GI:86753749 |
| 309. Influenza A virus (A/duck/Vietnam/8/05(H5N1)) hemagglutinin mRNA, complete cds | 1,779 bp linear mRNA | DQ366322.1 GI:86753759 |
| 310. Influenza A virus (A/duck/Vietnam/8/05(H5N1)) nucleocapsid mRNA, complete cds | 1,565 bp linear mRNA | DQ366323.1 GI:86753769 |
| 311. Influenza A virus (A/duck/Vietnam/8/05(H5N1)) neuraminidase mRNA, complete cds | 1,401 bp linear mRNA | DQ366324.1 GI:86753779 |
| 312. Influenza A virus (A/duck/Vietnam/8/05(H5N1)) matrix protein mRNA, complete cds | 1,027 bp linear mRNA | DQ366325.1 GI:86753789 |
| 313. Influenza A virus (A/duck/Yangzhou/232/2004(H5N1)) nonfunctional nonstructural protein (NS) mRNA, complete sequence | 876 bp linear mRNA | DQ354060.1 GI:87128645 |
| 314. Influenza A virus (A/duck/Zhejiang/11/2000(H5N1)) polymerase basic protein 2 (PB2) mRNA, complete cds | 2,281 bp linear mRNA | AY585523.1 GI:47156264 |
| 315. Influenza A virus (A/duck/Zhejiang/11/2000(H5N1)) matrix protein mRNA, complete cds | 760 bp linear mRNA | AY585396.1 GI:47156346 |
| 316. Influenza A virus (A/duck/Zhejiang/11/2000(H5N1)) neuraminidase (NA) mRNA, complete cds | 1,352 bp linear mRNA | AY585418.1 GI:47156390 |
| 317. Influenza A virus (A/duck/Zhejiang/11/2000(H5N1)) nucleoprotein (NP) mRNA, complete cds | 1,498 bp linear mRNA | AY585439.1 GI:47156432 |
| 318. Influenza A virus (A/duck/Zhejiang/11/2000(H5N1)) nonstructural protein 1 (NS1) mRNA, partial cds | 687 bp linear mRNA | AY585460.1 GI:47156474 |
| 319. Influenza A virus (A/duck/Zhejiang/52/2000(H5N1)) polymerase basic protein 2 (PB2) mRNA, complete cds | 2,281 bp linear mRNA | AY585524.1 GI:47156266 |
| 320. Influenza A virus (A/duck/Zhejiang/52/2000(H5N1)) matrix protein mRNA, complete cds | 760 bp linear mRNA | AY585397.1 GI:47156348 |
| 321. Influenza A virus (A/duck/Zhejiang/52/2000(H5N1)) neuraminidase (NA) mRNA, complete cds | 1,423 bp linear mRNA | AY585419.1 GI:47156392 |
| 322. Influenza A virus (A/duck/Zhejiang/52/2000(H5N1)) nucleoprotein (NP) mRNA, complete cds | 1,499 bp linear mRNA | AY585440.1 GI:47156434 |
| 323. Influenza A virus (A/duck/Zhejiang/52/2000(H5N1)) nonstructural protein 1 (NS1) mRNA, complete cds | 686 bp linear mRNA | AY585461.1 GI:47156476 |
| 324. Influenza A virus (A/Egypt/0636-NAMRU3/2007(H5N1)) hemagglutinin (HA) mRNA, complete cds | 1,749 bp linear mRNA | EF382359.1 GI:124244205 |
| 325. Influenza A virus (A/goosander/Switzerland/V82/06 (H5N1)) hemagglutinin (HA) gene, complete cds | 1,707 bp linear mRNA | EF110518.1 GI:119394674 |
| 326. Influenza A virus (A/goose/Guangdong/1/96/(H5N1)) hemagglutinin mRNA, complete cds | 1,707 bp linear mRNA | AF148678.1 GI:5007022 |

TABLE 9-continued

Influenza H5N1 Antigens

| Strain/Protein | Length | GenBank/GI Accession No. |
| --- | --- | --- |
| 327. Influenza A virus (A/Goose/Huadong/1/2000(H5N1)) hemagglutinin (HA) mRNA, complete cds | 1,779 bp linear mRNA | DQ201829.1 GI:76786306 |
| 328. Influenza A virus (A/Goose/Huadong/1/2000(H5N1)) neuraminidase (NA) mRNA, complete cds | 1,458 bp linear mRNA | DQ201830.1 GI:76786308 |
| 329. Influenza A virus (A/goose/Hungary/2823/2/2007(H5N1)) polymerase PB1 (PB1) mRNA, partial cds | 2,287 bp linear mRNA | EF446768.1 GI:126428373 |
| 330. Influenza A virus (A/goose/Hungary/2823/2/2007(H5N1)) polymerase PB2 (PB2) mRNA, partial cds | 2,274 bp linear mRNA | EF446769.1 GI:126428375 |
| 331. Influenza A virus (A/goose/Hungary/2823/2/2007(H5N1)) polymerase PA (PA) mRNA, complete cds | 2,175 bp linear mRNA | EF446770.1 GI:126428377 |
| 332. Influenza A virus (A/goose/Hungary/2823/2/2007(H5N1)) hemagglutinin (HA) mRNA, complete cds | 1,735 bp linear mRNA | EF446771.1 GI:126428379 |
| 333. Influenza A virus (A/goose/Hungary/2823/2/2007(H5N1)) nucleocapsid protein (NP) mRNA, partial cds | 1,473 bp linear mRNA | EF446772.1 GI:126428381 |
| 334. Influenza A virus (A/goose/Hungary/2823/2/2007(H5N1)) neuraminidase (NA) mRNA, partial cds | 1,311 bp linear mRNA | EF446773.1 GI:126428383 |
| 335. Influenza A virus (A/goose/Hungary/2823/2/2007(H5N1)) matrix protein 1 (M1) mRNA, partial cds | 971 bp linear mRNA | EF446774.1 GI:126428385 |
| 336. Influenza A virus (A/goose/Hungary/2823/2/2007(H5N1)) nonstructural protein 1 (NS1) mRNA, partial cds | 795 bp linear mRNA | EF446775.1 GI:126428387 |
| 337. Influenza A virus (A/goose/Hungary/3413/2007(H5N1)) polymerase PB1 (PB1) mRNA, partial cds | 2,277 bp linear mRNA | EF446776.1 GI:126428389 |
| 338. Influenza A virus (A/goose/Hungary/3413/2007(H5N1)) polymerase PB2 (PB2) mRNA, partial cds | 2,274 bp linear mRNA | EF446777.1 GI:126428391 |
| 339. Influenza A virus (A/goose/Hungary/3413/2007 (H5N1)) polymerase PA (PA) mRNA, partial cds | 2,163 bp linear mRNA | EF446778.1 GI:126428393 |
| 340. Influenza A virus (A/goose/Hungary/3413/2007 (H5N1)) hemagglutinin (HA) mRNA, complete cds | 1,722 bp linear mRNA | EF446779.1 GI:126428395 |
| 341. Influenza A virus (A/goose/Hungary/3413/2007 (H5N1)) nucleocapsid protein (NP) mRNA, partial cds | 1,463 bp linear mRNA | EF446780.1 GI:126428397 |
| 342. Influenza A virus (A/goose/Hungary/3413/2007(H5N1)) neuraminidase (NA) mRNA, partial cds | 1,289 bp linear mRNA | EF446781.1 GI:126428399 |
| 343. Influenza A virus (A/goose/Hungary/3413/2007(H5N1)) matrix protein 1 (M1) mRNA, partial cds | 955 bp linear mRNA | EF446782.1 GI:126428401 |
| 344. Influenza A virus (A/goose/Hungary/3413/2007(H5N1)) nonstructural protein 1 (NS1) mRNA, complete cds | 805 bp linear mRNA | EF446783.1 GI:126428403 |
| 345. Influenza A virus (A/goose/jiangsu/131/2002(H5N1)) nonfunctional nonstructural protein (NS) mRNA, complete sequence | 877 bp linear mRNA | DQ354061.1 GI:87128646 |
| 346. Influenza A virus (A/goose/Jiangsu/220/2003(H5N1)) nonstructural protein (NS) mRNA, complete cds | 875 bp linear mRNA | DQ354062.1 GI:87128647 |
| 347. Influenza A virus (A/goose/Krasnoozerka/627/2005(H5N1)) hemagglutinin (HA) mRNA, complete cds | 1,754 bp linear mRNA | DQ676840.1 GI:108782531 |
| 348. Influenza A virus (A/goose/Krasnoozerka/627/2005(H5N1)) nucleoprotein (NP) mRNA, complete cds | 1,530 bp linear mRNA | DQ676841.1 GI:108782533 |
| 349. Influenza A virus (A/goose/Krasnoozerka/627/2005(H5N1)) nonstructural protein (NS) mRNA, complete cds | 850 bp linear mRNA | DQ676842.1 GI:108782535 |
| 350. Influenza A virus (A/goose/Vietnam/3/05(H5N1)) nonstructural protein 1 mRNA, complete cds | 890 bp linear mRNA | DQ366318.1 GI:86753717 |

TABLE 9-continued

| Influenza H5N1 Antigens | | |
|---|---|---|
| Strain/Protein | Length | GenBank/GI Accession No. |
| 351. Influenza A virus (A/goose/Vietnam/3/05(H5N1)) polymerase PB2 mRNA, complete cds | 2,341 bp linear mRNA | DQ366311.1 GI:86753727 |
| 352. Influenza A virus (A/goose/Vietnam/3/05(H5N1)) polymerase PB1 mRNA, complete cds | 2,341 bp linear mRNA | DQ366312.1 GI:86753737 |
| 353. Influenza A virus (A/goose/Vietnam/3/05(H5N1)) PA protein mRNA, complete cds | 2,233 bp linear mRNA | DQ366313.1 GI:86753747 |
| 354. Influenza A virus (A/goose/Vietnam/3/05(H5N1)) hemagglutinin mRNA, complete cds | 1,779 bp linear mRNA | DQ366314.1 GI:86753757 |
| 355. Influenza A virus (A/goose/Vietnam/3/05(H5N1)) nucleocapsid mRNA, complete cds | 1,565 bp linear mRNA | DQ366315.1 GI:86753767 |
| 356. Influenza A virus (A/goose/Vietnam/3/05(H5N1)) neuraminidase mRNA, complete cds | 1,401 bp linear mRNA | DQ366316.1 GI:86753777 |
| 357. Influenza A virus (A/goose/Vietnam/3/05(H5N1)) matrix protein mRNA, complete cds | 1,027 bp linear mRNA | DQ366317.1 GI:86753787 |
| 358. Influenza A virus (A/gull/Pennsylvania/4175/83(H5N1)) hemagglutinin H5 mRNA, partial cds | 1,700 bp linear mRNA | AF082043.1 GI:4240453 |
| 360. Influenza A virus (A/HongKong/156/97(H5N1)) neuraminidase mRNA, complete cds | 1,388 bp linear mRNA | AF028708.1 GI:2865377 |
| 361. Influenza A virus (A/HongKong/156/97(H5N1)) hemagglutinin mRNA, complete cds | 1,741 bp linear mRNA | AF028709.1 GI:2865379 |
| 362. Influenza A virus (A/HongKong/156/97(H5N1)) nucleoprotein mRNA, complete cds | 1,549 bp linear mRNA | AF028710.1 GI:2865381 |
| 363. Influenza A virus (A/hooded vulture/Burkina Faso/1/2006(H5N1)) partial mRNA for nucleoprotein (np gene) | 1,451 bp linear mRNA | AM503028.1 GI:147846292 |
| 364. Influenza A virus (A/hooded vulture/Burkina Faso/1/2006(H5N1)) mRNA for non-structural protein (ns gene) | 827 bp linear mRNA | AM503038.1 GI:147846312 |
| 365. Influenza A virus (A/hooded vulture/Burkina Faso/1/2006(H5N1)) partial mRNA for polymerase (pa gene) | 2,169 bp linear mRNA | AM503047.1 GI:147846330 |
| 366. Influenza A virus (A/hooded vulture/Burkina Faso/1/2006(H5N1)) partial mRNA for polymerase basic protein 1 (pb1 gene) | 1,686 bp linear mRNA | AM503065.1 GI:147846855 |
| 367. Influenza A virus (A/hooded vulture/Burkina Faso/2/2006(H5N1)) partial mRNA for matrix protein 1 (m1 gene) | 977 bp linear mRNA | AM503006.1 GI:147846248 |
| 368. Influenza A virus (A/hooded vulture/Burkina Faso/2/2006(H5N1)) partial mRNA for neuraminidase (na gene) | 1,336 bp linear mRNA | AM503017.1 GI:147846270 |
| 369. Influenza A virus (A/hooded vulture/Burkina Faso/2/2006(H5N1)) partial mRNA for nucleoprotein (np gene) | 1,499 bp linear mRNA | AM503027.1 GI:147846290 |
| 370. Influenza A virus (A/hooded vulture/Burkina Faso/2/2006(H5N1)) mRNA for non-structural protein (ns gene) | 827 bp linear mRNA | AM503039.1 GI:147846314 |
| 371. Influenza A virus (A/hooded vulture/Burkina Faso/2/2006(H5N1)) partial mRNA for polymerase (pa gene) | 2,169 bp linear mRNA | AM503048.1 GI:147846332 |
| 372. Influenza A virus (A/hooded vulture/Burkina Faso/2/2006(H5N1)) partial mRNA for polymerase basic protein 1 (pb1 gene) | 2,259 bp linear mRNA | AM503062.1 GI:147846849 |
| 373. Influenza A virus (A/hooded vulture/Burkina Faso/2/2006(H5N1)) partial mRNA for polymerase basic protein 2 (pb2 gene) | 2,315 bp linear mRNA | AM503066.1 GI:147846857 |
| 374. Influenza A virus (A/Indonesia/CDC177/2005(H5N1)) M2 protein mRNA, complete cds | 294 bp linear mRNA | EU014135.1 GI:151336850 |
| 375. Influenza A virus (A/Indonesia/CDC298/2005(H5N1)) M2 protein mRNA, complete cds | 294 bp linear mRNA | EU014138.1 GI:151336856 |
| 376. Influenza A virus (A/Indonesia/CDC485/2006(H5N1)) M2 protein mRNA, complete cds | 294 bp linear mRNA | EU014136.1 GI:151336852 |

TABLE 9-continued

| Influenza H5N1 Antigens | | |
|---|---|---|
| Strain/Protein | Length | GenBank/GI Accession No. |
| 377. Influenza A virus (A/Indonesia/CDC530/2006(H5N1)) M2 protein mRNA, complete cds | 294 bp linear mRNA | EU014134.1 GI:151336848 |
| 378. Influenza A virus (A/Indonesia/CDC535/2006(H5N1)) M2 protein mRNA, complete cds | 294 bp linear mRNA | EU014133.1 GI:151336846 |
| 379. Influenza A virus (A/Indonesia/CDC540/2006(H5N1)) M2 protein mRNA, complete cds | 294 bp linear mRNA | EU014132.1 GI:151336844 |
| 380. Influenza A virus (A/Indonesia/CDC561/2006(H5N1)) M2 protein mRNA, complete cds | 294 bp linear mRNA | EU014137.1 GI:151336854 |
| 381. Influenza A virus (A/Indonesia/CDC60/2005(H5N1)) M2 protein mRNA, complete cds | 294 bp linear mRNA | EU014139.1 GI:151336858 |
| 382. Influenza A virus (A/mallard/Wisconsin/428/75(H5N1)) hemagglutinin mRNA, partial cds | 996 bp linear mRNA | U79453.1 GI:1840071 |
| 383. Influenza A virus (A/ostrich/VRLCU/Egypt/2011(H5N1)) segment 4 hemagglutinin (HA) mRNA, partial cds | 441 bp linear mRNA | JN157759.1 GI:338223304 |
| 384. Influenza A virus (A/quail/yunnan/092/2002(H5N1)) nonstructural protein (NS) mRNA, complete cds | 875 bp linear mRNA | DQ354063.1 GI:87128649 |
| 385. Influenza A virus (A/R(Turkey/Ontario/7732/66-Bellamy/42)(H5N1)) HA mRNA for hemagglutinin, partial cds | 1,472 bp linear mRNA | AB241613.1 GI:82581222 |
| 386. Influenza A virus (A/Thailand/LFPN-2004/2004(H5N1)) neuraminidase mRNA, complete cds | 1,350 bp linear mRNA | AY679513.1 GI:50843945 |
| 387. Influenza A virus (A/Thailand/LFPN-2004/2004(H5N1)) hemagglutinin mRNA, complete cds | 1,704 bp linear mRNA | AY679514.1 GI:50843949 |
| 388. Influenza A virus (A/tiger/Thailand/CU-T4/04(H5N1)) polymerase basic protein 2 (PB2) mRNA, partial cds | 534 bp linear mRNA | DQ017251.1 GI:65329524 |
| 389. Influenza A virus (A/tiger/Thailand/CU-T5/04(H5N1)) polymerase basic protein 2 (PB2) mRNA, partial cds | 582 bp linear mRNA | DQ017252.1 GI:65329536 |
| 390. Influenza A virus (A/tiger/Thailand/CU-T6/04(H5N1)) polymerase basic protein 2 (PB2) mRNA, partial cds | 564 bp linear mRNA | DQ017253.1 GI:65329553 |
| 391. Influenza A virus (A/tiger/Thailand/CU-T8/04(H5N1)) polymerase basic protein 2 (PB2) mRNA, partial cds | 582 bp linear mRNA | DQ017254.1 GI:65329568 |
| 392. Influenza A virus (A/turkey/England/250/2007(H5N1)) hemagglutinin (HA) mRNA, partial cds | 1,695 bp linear mRNA | EF441263.1 GI:129307104 |
| 393. Influenza A virus (A/turkey/England/250/2007(H5N1)) matrix protein (M) mRNA, partial cds | 943 bp linear mRNA | EF441264.1 GI:129307106 |
| 394. Influenza A virus (A/turkey/England/250/2007(H5N1)) nonstructural protein 1 (NS1) mRNA, complete cds | 812 bp linear mRNA | EF441265.1 GI:129307109 |
| 395. Influenza A virus (A/turkey/England/250/2007(H5N1)) polymerase PA (PA) mRNA, complete cds | 2,185 bp linear mRNA | EF441266.1 GI:129307111 |
| 396. Influenza A virus (A/turkey/England/250/2007(H5N1)) polymerase PB2 (PB2) mRNA, partial cds | 2,272 bp linear mRNA | EF441267.1 GI:129307113 |
| 397. Influenza A virus (A/turkey/England/250/2007(H5N1)) nucleocapsid (NP) mRNA, partial cds | 1,396 bp linear mRNA | EF441268.1 GI:129307115 |
| 398. Influenza A virus (A/turkey/England/250/2007(H5N1)) polymerase PB1 (PB1) mRNA, partial cds | 2,288 bp linear mRNA | EF441269.1 GI:129307117 |
| 399. Influenza A virus (A/turkey/England/250/2007(H5N1)) neuraminidase (NA) mRNA, partial cds | 1,276 bp linear mRNA | EF441270.1 GI:129307119 |
| A/chicken/Burkina Faso/13.1/2006(H5N1) neuraminidase (NA) | | AM503016.1 |
| A/chicken/Crimea/04/2005(H5N1) neuraminidase (NA) | | DQ650661.1 |
| A/chicken/Crimea/04/2005(H5N1) hemagglutinin | | DQ650659.1 |

TABLE 9-continued

| Influenza H5N1 Antigens | | |
|---|---|---|
| Strain/Protein | Length | GenBank/GI Accession No. |
| A/chicken/Crimea/08/2005(H5N1) polymerase basic protein 1 (PB1) | | DQ650669.1 |
| A/chicken/Crimea/08/2005(H5N1) neuraminidase (NA) | | DQ650665.1 |
| A/chicken/Crimea/08/2005(H5N1) hemagglutinin (HA) | | DQ650663.1 |
| A/chicken/Guangxi/12/2004(H5N1) nonstructural protein 1 | | DQ366334.1 |
| A/chicken/Guangxi/12/2004(H5N1) neuraminidase | | DQ366332.1 |
| A/chicken/Guangxi/12/2004(H5N1) hemagglutinin | | DQ366330.1 |
| A/duck/Kurgan/08/2005(H5N1) nucleoprotein (NP) | | DQ449643.1 |

TABLE 10

| Other Influenza A Antigens (H1N*, H2N*, H3N*) | | |
|---|---|---|
| Strain/Protein | Length | GenBank/GI Accession Nos. |
| H1N* | | |
| Influenza A virus (A/duck/Hong Kong/193/1977(H1N2)) nucleoprotein (NP) mRNA, partial cds | 1,402 bp linear mRNA | U49097.1 GI:1912392 |
| Influenza A virus (A/duck/Hong Kong/193/1977(H1N2)) polymerase (PB1) mRNA, partial cds | 258 bp linear mRNA | U48285.1 GI:1912374 |
| Influenza A virus (A/England/2/2002(H1N2)) partial NS1 gene for non structural protein 1 and partial NS2 gene for non structural protein 2, genomic RNA | 795 bp linear mRNA | AJ519455.1 GI:31096426 |
| Influenza A virus (A/England/3/02(H1N2)) partial mRNA for nucleoprotein (np gene) | 384 bp linear mRNA | AJ489497.1 GI:27526856 |
| Influenza A virus (A/England/3/02(H1N2)) partial mRNA for polymerase subunit 2 (pb2 gene) | 442 bp linear mRNA | AJ489488.1 GI:27526838 |
| Influenza A virus (A/England/5/02(H1N2)) partial mRNA for nucleoprotein (np gene) | 384 bp linear mRNA | AJ489498.1 GI:27526858 |
| Influenza A virus (A/England/5/02(H1N2)) partial mRNA for polymerase subunit 2 (pb2 gene) | 442 bp linear mRNA | AJ489489.1 GI:27526840 |
| Influenza A virus (A/England/57/02(H1N2)) partial mRNA for nucleoprotein (np gene) | 384 bp linear mRNA | AJ489499.1 GI:27526860 |
| Influenza A virus (A/England/57/02(H1N2)) partial mRNA for polymerase subunit 2 (pb2 gene) | 442 bp linear mRNA | AJ489492.1 GI:27526846 |
| Influenza A virus (A/England/691/01(H1N2)) partial mRNA for nucleoprotein (np gene) | 384 bp linear mRNA | AJ489496.1 GI:27526854 |
| Influenza A virus (A/England/73/02(H1N2)) partial mRNA for nucleoprotein (np gene) | 384 bp linear mRNA | AJ489500.1 GI:27526862 |
| Influenza A virus (A/England/73/02(H1N2)) partial mRNA for polymerase subunit 2 (pb2 gene) | 442 bp linear mRNA | AJ489493.1 GI:27526848 |
| Influenza A virus (A/England/90/02(H1N2)) partial mRNA for nucleoprotein (np gene) | 384 bp linear mRNA | AJ489501.1 GI:27526864 |
| Influenza A virus (A/England/90/02(H1N2)) partial mRNA for polymerase subunit 2 (pb2 gene) | 442 bp linear mRNA | AJ489490.1 GI:27526842 |
| Influenza A virus (A/England/97/02(H1N2)) partial mRNA for nucleoprotein (np gene) | 384 bp linear mRNA | AJ489502.1 GI:27526866 |
| Influenza A virus (A/England/97/02(H1N2)) partial mRNA for polymerase subunit 2 (pb2 gene) | 442 bp linear mRNA | AJ489491.1 GI:27526844 |
| Influenza A virus (A/England/627/01(H1N2)) partial mRNA for nucleoprotein (np gene) | 384 bp linear mRNA | AJ489494.1 GI:27526850 |
| Influenza A virus (A/England/627/01(H1N2)) partial mRNA for polymerase subunit 2 (pb2 gene) | 442 bp linear mRNA | AJ489485.1 GI:27526832 |

TABLE 10-continued

| Other Influenza A Antigens (H1N*, H2N*, H3N*) | | |
|---|---|---|
| Strain/Protein | Length | GenBank/GI Accession Nos. |
| Influenza A virus (A/England/691/01(H1N2)) partial mRNA for polymerase subunit 2 (pb2 gene) | 442 bp linear mRNA | AJ489487.1 GI:27526836 |
| Influenza A virus (A/Egypt/96/2002(H1N2)) partial NS1 gene for non structural protein 1 and partial NS2 gene for non structural protein 2, genomic RNA | 747 bp linear mRNA | AJ519457.1 GI:31096432 |
| Influenza A virus (A/Israel/6/2002(H1N2)) partial NS1 gene for non structural protein 1 and partial NS2 gene for non structural protein 2, genomic RNA | 773 bp linear mRNA | AJ519456.1 GI:31096429 |
| Influenza A virus (A/Saudi Arabia/2231/2001(H1N2)) partial NS1 gene for non structural protein 1 and partial NS2 gene for non structural protein 2, genomic RNA | 772 bp linear mRNA | AJ519453.1 GI:31096420 |
| Influenza A virus (A/Scotland/122/01(H1N2)) partial mRNA for nucleoprotein (np gene) | 384 bp linear mRNA | AJ489495.1 GI:27526852 |
| Influenza A virus (A/Scotland/122/01(H1N2)) partial mRNA for polymerase subunit 2 (pb2 gene) | 442 bp linear mRNA | AJ489486.1 GI:27526834 |
| Influenza A virus (A/swine/Bakum/1832/2000(H1N2)) hemagglutinin (HA) mRNA, partial cds | 832 bp linear mRNA | AY861443.1 GI:57791765 |
| Influenza A virus (A/swine/Bakum/1832/2000(H1N2)) neuraminidase mRNA, partial cds | 467 bp linear mRNA | AY870645.1 GI:58042754 |
| Influenza A virus (A/swine/Cotes d'Armor/0040/2007(H1N2)) segment 4 partial mRNA | 1,039 bp linear mRNA | AM503547.1 GI:225578611 |
| Influenza A virus (A/swine/Cotes d'Armor/0136_17/2006(H1N2)) partial mRNA for haemagglutinin precursor (HA1 gene) | 1,136 bp linear mRNA | AM490224.3 GI:222062921 |
| Influenza A virus (A/swine/England/72685/96(H1N2)) haemagglutinin precursor, mRNA, complete cds | 1,778 bp linear mRNA | AF085417.1 GI:3831770 |
| Influenza A virus (A/swine/England/17394/96(H1N2)) haemagglutinin precursor, mRNA, complete cds | 1,778 bp linear mRNA | AF085416.1 GI:3831768 |
| Influenza A virus (A/swine/England/690421/95(H1N2)) haemagglutinin precursor, mRNA, complete cds | 1,778 bp linear mRNA | AF085415.1 GI:3831766 |
| Influenza A virus (A/swine/England/438207/94(H1N2)) haemagglutinin precursor, mRNA, complete cds | 1,778 bp linear mRNA | AF085414.1 GI:3831764 |
| Influenza A virus (A/Swine/Korea/CY02/02(H1N2)) neuraminidase (NA) mRNA, complete cds | 1,427 bp linear mRNA | AY129157.1 GI:24286064 |
| Influenza A virus (A/Swine/Korea/CY02/02(H1N2)) matrix protein (M) mRNA, complete cds | 952 bp linear mRNA | AY129158.1 GI:24286066 |
| Influenza A virus (A/Swine/Korea/CY02/02(H1N2)) nucleoprotein (NP) mRNA, complete cds | 1,542 bp linear mRNA | AY129159.1 GI:24286069 |
| Influenza A virus (A/Swine/Korea/CY02/02(H1N2)) nonstructural protein (NS) mRNA, complete cds | 842 bp linear mRNA | AY129160.1 GI:24286081 |
| Influenza A virus (A/Swine/Korea/CY02/02(H1N2)) polymerase acidic protein 2 (PA) mRNA, complete cds | 2,165 bp linear mRNA | AY129161.1 GI:24286087 |
| Influenza A virus (A/Swine/Korea/CY02/02(H1N2)) polymerase subunit 1 (PB1) mRNA, complete cds | 2,274 bp linear mRNA | AY129162.1 GI:24286096 |
| Influenza A virus (A/Swine/Korea/CY02/02(H1N2)) polymerase subunit 2 (PB2) mRNA, complete cds | 2,334 bp linear mRNA | AY129163.1 GI:24286100 |
| Influenza A virus (A/swine/Scotland/410440/94(H1N2)) haemagglutinin precursor, mRNA, complete cds | 1,778 bp linear mRNA | AF085413.1 GI:3831762 |
| Influenza A virus (A/swine/Spain/80598-LP4/2007(H1N2)) matrix protein 2 (M2) mRNA, partial cds | 291 bp linear mRNA | EU305436.1 GI:168830657 |
| Influenza A virus (A/Switzerland/3100/2002(H1N2)) partial HA gene for Haemagglutinin, genomic RNA | 975 bp linear mRNA | AJ517813.1 GI:38422519 |

TABLE 10-continued

| Other Influenza A Antigens (H1N*, H2N*, H3N*) | | |
|---|---|---|
| Strain/Protein | Length | GenBank/GI Accession Nos. |
| Influenza A virus (A/duck/Hong Kong/717/1979(H1N3)) nucleoprotein (NP) mRNA, partial cds | 1,387 bp linear mRNA | U49095.1 GI:1912388 |
| Influenza A virus (A/duck/Hong Kong/717/1979(H1N3)) polymerase (PB1) mRNA, partial cds | 265 bp linear mRNA | U48281.1 GI:1912366 |
| Influenza A virus (A/herring gull/New Jersey/780/86 (H1N3)) nonfunctional matrix protein mRNA, partial sequence | 971 bp linear mRNA | AY664422.1 GI:51011826 |
| Influenza A virus (A/mallard/Alberta/42/77(H1N6)) nonfunctional matrix protein mRNA, partial sequence | 997 bp linear mRNA | AY664426.1 GI:51011830 |
| Influenza A virus (A/swine/England/191973/92(H1N7)) matrix protein Ml mRNA, complete cds | 1,020 bp linear mRNA | U85985.1 GI:1835733 |
| Influenza A virus (A/swine/England/191973/92(H1N7)) nucleoprotein mRNA, complete cds | 1,524 bp linear mRNA | U85987.1 GI:1835737 |
| Influenza A virus (A/swine/England/191973/92(H1N7)) neuraminidase mRNA, complete cds | 1,458 bp linear mRNA | U85988.1 GI:1835739 |
| Influenza A virus (A/swine/England/191973/92 (H1N7) ) haemagglutinin HA mRNA, partial cds | 1,698 bp linear mRNA | U85986.1 GI:1835735 |
| H2N* | | |
| Influenza A virus (A/ruddy turnstone/Delaware/81/93 (H2N1)) nonfunctional matrix protein mRNA, partial sequence | 917 bp linear mRNA | AY664465.1 GI:51011869 |
| Influenza A virus (A/ruddy turnstone/Delaware/34/93 (H2N1)) nonfunctional matrix protein mRNA, partial sequence | 968 bp linear mRNA | AY664429.1 GI:51011833 |
| Influenza A virus (A/Shorebird/Delaware/122/97(H2N1)) nonfunctional matrix protein mRNA, partial sequence | 925 bp linear mRNA | AY 66 4 466.1 GI:51011870 |
| Influenza A virus (A/shorebird/Delaware/138/97 (H2N1)) nonfunctional matrix protein mRNA, partial sequence | 958 bp linear mRNA | AY664454.1 GI:51011858 |
| Influenza A virus (A/shorebird/Delaware/111/97 (H2N1)) nonfunctional matrix protein mRNA, partial sequence | 958 bp linear mRNA | AY664457.1 GI:51011861 |
| Influenza A virus (A/shorebird/Delaware/24/98 (H2N1)) nonfunctional matrix protein mRNA, partial sequence | 979 bp linear mRNA | AY664442.1 GI:51011846 |
| Influenza virus type A/Leningrad/134/17/57 (H2N2) PA RNA, complete cds | 2,233 bp linear mRNA | M81579.1 GI:324935 |
| Influenza A virus (STRAIN A/MALLARD/NEW YORK/6750/78) partial mRNA for PA protein | 2,151 bp linear mRNA | AJ243994.1 GI:5918195 |
| Influenza A virus (A/X-7(F1)/(H2N2)) neuraminidase mRNA, complete cds | 1,467 bp linear mRNA | M11205.1 GI:323969 |
| Influenza A virus (A/mallard/Alberta/77/77 (H2N3)) nonfunctional matrix protein mRNA, partial sequence | 1,009 bp linear mRNA | AY664425.1 GI:51011829 |
| Influenza A virus (A/mallard/Alberta/226/98(H2N3)) nonfunctional matrix protein mRNA, partial sequence | 968 bp linear mRNA | AY664447.1 GI:51011851 |
| Influenza A virus (A/sanderling/New Jersey/766/86 (H2N7)) nonfunctional matrix protein mRNA, partial sequence | 846 bp linear mRNA | AY664477.1 GI:51011881 |
| Influenza A virus (A/laughing gull/New Jersey/798/86 (H2N7)) nonfunctional matrix protein mRNA, partial sequence | 907 bp linear mRNA | AY664471.1 GI:51011875 |
| Influenza A virus (A/herring gull/Delaware/471/1986(H2N7)) nonfunctional matrix protein mRNA, partial sequence | 960 bp linear mRNA | AY664440.1 GI:51011844 |
| Influenza A virus (A/ruddy turnstone/Delaware/142/98 (H2N8)) | 1,011 bp linear mRNA | AY664423.1 GI:51011827 |

TABLE 10-continued

| Strain/Protein | Length | GenBank/GI Accession Nos. |
|---|---|---|
| Other Influenza A Antigens (H1N*, H2N*, H3N*) | | |
| nonfunctional matrix protein mRNA, partial sequence | | |
| Influenza A virus (A/pintail/Alberta/293/77 (H2N9)) nonfunctional matrix protein mRNA, partial sequence | 906 bp linear mRNA | AY664473.1 GI:51011877 |
| Influenza A virus (A/blue-winged teal/Alberta/16/97 (H2N9)) nonfunctional matrix protein mRNA, partial sequence | 961 bp linear mRNA | AY664449.1 GI:51011853 |
| Influenza A virus (A/Laughing gull/New Jersey/75/85 (H2N9)) nonfunctional matrix protein mRNA, partial sequence | 952 bp linear mRNA | AY664437.1 GI:51011841 |
| Influenza A virus (A/mallard/Alberta/205/98 (H2N9)) nonfunctional matrix protein mRNA, partial sequence | 959 bp linear mRNA | AY664450.1 GI:51011854 |
| H3N* | | |
| Influenza A virus (A/duck/Eastern China/267/2003(H3N1)) segment 6 neuraminidase (NA) mRNA, complete cds | 1,458 bp linear mRNA | EU429755.1 GI:167859475 |
| Influenza A virus (A/duck/Eastern China/253/2003(H3N1)) segment 6 neuraminidase (NA) mRNA, complete cds | 1,458 bp linear mRNA | EU429754.1 GI:167859473 |
| Influenza A virus (A/duck/Eastern China/252/2003(H3N1)) segment 6 neuraminidase (NA) mRNA, complete cds | 1,458 bp linear mRNA | EU429753.1 GI:167859471 |
| Influenza A virus (A/duck/Eastern China/243/2003(H3N1)) segment 6 neuraminidase (NA) mRNA, complete cds | 1,458 bp linear mRNA | EU429752.1 GI:167859469 |
| Influenza A virus (A/duck/Eastern China/262/2003(H3N1)) segment 6 neuraminidase (NA) mRNA, complete cds | 1,458 bp linear mRNA | EU429734.1 GI:167859433 |
| Influenza A virus (A/duck/Eastern China/233/2003(H3N1)) segment 6 neuraminidase (NA) mRNA, complete cds | 1,459 bp linear mRNA | EU429733.1 GI:167859431 |
| Influenza A virus (A/duck/Eastern China/213/2003(H3N1)) segment 6 neuraminidase (NA) mRNA, complete cds | 1,458 bp linear mRNA | EU429723.1 GI:167859411 |
| Influenza A virus (A/duck/Eastern China/341/2003(H3N1)) segment 6 neuraminidase (NA) mRNA, complete cds | 1,458 bp linear mRNA | EU429719.1 GI:167859403 |
| Influenza A virus (A/duck/Eastern China/01/2002(H3N1)) segment 6 neuraminidase (NA) mRNA, complete cds | 1,458 bp linear mRNA | EU429718.1 GI:167859401 |
| Influenza A virus (A/mallard/Alberta/22/76 (H3N6)) nonfunctional matrix protein mRNA, partial sequence | 1,013 bp linear mRNA | AY664434.1 GI:51011838 |
| Influenza A virus (A/mallard/Alberta/199/99(H3N6)) nonfunctional matrix protein mRNA, partial sequence | 970 bp linear mRNA | AY664443.1 GI:51011847 |
| Influenza A virus (A/shorebird/Delaware/222/97 (H3N6)) nonfunctional matrix protein mRNA, partial sequence | 922 bp linear mRNA | AY664461.1 GI:51011865 |
| Influenza A virus (A/Duck/Hokkaido/8/80 (H3N8)) hemagglutinin precursor, mRNA, partial cds | 984 bp linear mRNA | AF079570.1 GI:3414978 |
| Influenza A virus (A/Duck/Hokkaido/8/80 (H3N8)) nucleoprotein mRNA, complete cds | 1,497 bp linear mRNA | AF079571.1 GI:3414980 |
| Influenza A virus (A/duck/Ukraine/1/1963(H3N8)) segment 6 neuraminidase (NA) mRNA, complete cds | 1,461 bp linear mRNA | EU429797.1 GI:167859559 |
| Influenza A virus (A/duck/Eastern China/19/2004(H3N8)) segment 6 neuraminidase (NA) mRNA, complete cds | 1,460 bp linear mRNA | EU429698.1 GI:167859361 |
| Influenza A virus (A/duck/Eastern China/90/2004(H3N8)) segment 6 neuraminidase (NA) mRNA, complete cds | 1,460 bp linear mRNA | EU429700.1 GI:167859365 |
| Influenza A virus (A/duck/Eastern China/18/2005(H3N8)) segment 6 neuraminidase (NA) mRNA, complete cds | 1,460 bp linear mRNA | EU429787.1 GI:167859539 |
| Influenza A virus (A/duck/Eastern China/119/2005(H3N8)) segment 6 neuraminidase (NA) mRNA, complete cds | 1,460 bp linear mRNA | EU429788.1 GI:167859541 |

TABLE 10-continued

| Other Influenza A Antigens (H1N*, H2N*, H3N*) | | |
|---|---|---|
| Strain/Protein | Length | GenBank/GI Accession Nos. |
| Influenza A virus (A/equine/Argentina/1/96(H3N8)) hemagglutinin precursor (HA1) mRNA, partial cds | 1,061 bp linear mRNA | AF197246.1 GI:6651512 |
| Influenza A virus (A/equine/Argentina/2/94(H3N8)) hemagglutinin precursor (HA1) mRNA, partial cds | 1,061 bp linear mRNA | AF197245.1 GI:6651510 |
| Influenza A virus (A/equine/Argentina/1/95(H3N8)) hemagglutinin precursor (HA1) mRNA, partial cds | 1,061 bp linear mRNA | AF197244.1 GI:6651508 |
| Influenza A virus HA partial gene for haemagglutinin, genomic RNA, strain A/equine/Berlin/3/89(H3N8) | 1,026 bp linear mRNA | AJ223194.1 GI:2780201 |
| Influenza A virus HA partial gene for haemagglutinin, genomic RNA, strain A/equine/Berlin/4/89(H3N8) | 1,006 bp linear mRNA | AJ223195.1 GI:2780203 |
| Influenza A virus (A/equine/Florida/1/94(H3N8)) hemagglutinin precursor (HA1) mRNA, partial cds | 1,061 bp linear mRNA | AF197242.1 GI:6651504 |
| Influenza A virus (A/equine/Grobois/1/98(H3N8)) nonstructural protein NS1 mRNA, complete cds | 695 bp linear mRNA | AY328471.1 GI:32966577 |
| Influenza A virus (A/equi 2/Gotland/01(H3N8)) hemagglutinin HA1 subunit mRNA, partial cds | 473 bp linear mRNA | AY919314.1 GI:60250543 |
| Influenza A virus (A/eq/Kentucky/81(H3N8)) hemagglutinin mRNA, complete cds | 1,763 bp linear mRNA | U58195.1 GI:1377873 |
| Influenza A virus (A/equine/Kentucky/9/95(H3N8)) hemagglutinin precursor (HA1) mRNA, partial cds | 1,061 bp linear mRNA | AF197247.1 GI:6651514 |
| Influenza A virus (A/equine/Kentucky/1/96(H3N8)) hemagglutinin precursor (HA1) mRNA, partial cds | 1,061 bp linear mRNA | AF197248.1 GI:6651516 |
| Influenza A virus (A/equine/Kentucky/1/97(H3N8)) hemagglutinin precursor (HA1) mRNA, partial cds | 1,061 bp linear mRNA | AF197249.1 GI:6651518 |
| Influenza A virus (A/equine/Kentucky/1/98(H3N8)) hemagglutinin precursor (HA1) mRNA, partial cds | 1,061 bp linear mRNA | AF197241.1 GI:6651502 |
| Influenza A virus (A/equine/Santiago/85(H3N8)) nucleoprotein mRNA, complete cds | 1,497 bp linear mRNA | AY383753.1 GI:37223511 |
| Influenza A virus (A/equine/Santiago/85(H3N8)) hemagglutinin mRNA, complete cds | 1,698 bp linear mRNA | AY383755.1 GI:37223515 |
| Influenza A virus (A/equine/Santiago/85(H3N8)) neuraminidase mRNA, complete cds | 1,413 bp linear mRNA | AY383754.1 GI:37223513 |
| Influenza A virus (A/equine/Saskatoon/1/90(H3N8)) hemagglutinin precursor (HA1) mRNA, partial cds | 1,061 bp linear mRNA | AF197243.1 GI:6651506 |
| Influenza A virus (A/mallard/Alberta/114/97 (H3N8)) nonfunctional matrix protein mRNA, partial sequence | 1,010 bp linear mRNA | AY664432.1 GI:51011836 |
| Influenza A virus (A/mallard/Alberta/167/98 (H3N8)) nonfunctional matrix protein mRNA, partial sequence | 961 bp linear mRNA | AY664489.1 GI:51011893 |
| Influenza A virus (A/pintail/Alberta/37/99(H3N8)) nonfunctional matrix protein mRNA, partial sequence | 970 bp linear mRNA | AY664445.1 GI:51011849 |
| Influenza A virus (A/sanderling/Delaware/65/99 (H3N8)) nonfunctional matrix protein mRNA, partial sequence | 922 bp linear mRNA | AY664455.1 GI:51011859 |

TABLE 11

| Strain/Protein | GenBank Access No. |
|---|---|
| Other Influenza A Antigens (H4N*-H13N*) | |
| A/chicken/Singapore/1992(H4N1) M2 protein | EU014144.1 |
| A/mallard/Alberta/47/98(H4N1) nonfunctional matrix protein | AY664488.1 |
| A/duck/Hong Kong/412/1978(H4N2) polymerase (PB1) | U48279.1 |
| A/mallard/Alberta/300/77 (H4N3) nonfunctional matrix protein | AY664480.1 |
| A/Duck/Czechoslovakia/56(H4N6) segment 4 hemagglutinin | AF290436.1 |
| A/duck/Eastern China/376/2004(H4N6) segment 6neuraminidase (NA) | EU429792.1 |
| A/duck/Eastern China/01/2007(H4N6) segment 6 neuraminidase (NA) | EU429790.1 |
| A/duck/Eastern China/216/2007(H4N6) segment 6 neuraminidase (NA) | EU429789.1 |
| A/duck/Eastern China/166/2004(H4N6) segment 6 neuraminidase (NA) | EU429746.1 |
| A/duck/Eastern China/02/2003(H4N6) segment 6 neuraminidase (NA) | EU429713.1 |
| A/duck/Eastern China/160/2002(H4N6) segment 6 neuraminidase (NA) | EU429706.1 |
| A/mallard/Alberta/111/99(H4N6) nonfunctional matrix protein | AY664482.1 |
| A/mallard/Alberta/213/99 (H4N6) nonfunctional matrix protein | AY664460.1 |
| A/mallard/Alberta/30/98 (H4N6) nonfunctional matrix protein | AY664484.1 |
| A/blue-winged teal/Alberta/96/76 (H4N8) nonfunctional matrix protein | AY664420.1 |
| A/chicken/Florida/25717/1993(H5N2) hemagglutinin | U05332.1 |
| A/chicken/Hidalgo/26654-1368/1994(H5N2) hemagglutinin (HA) | U37172.1 |
| A/chicken/Jalisco/14585-660/1994(H5N2) hemagglutinin (HA) | U37181.1 |
| A/chicken/Mexico/26654-1374/1994(H5N2) hemagglutinin (HA) | U37173.1 |
| A/chicken/Mexico/31381-3/1994(H5N2) hemagglutinin (HA) | U37176.1 |
| A/chicken/Mexico/31381-6/1994(H5N2) hemagglutinin (HA) | U37175.1 |
| A/chicken/Mexico/31381-4/1994(H5N2) hemagglutinin (HA) | U37174.1 |
| A/chicken/Mexico/31381-5/1994(H5N2) hemagglutinin (HA) | U37169.1 |
| A/chicken/Mexico/31381-8/1994(H5N2) hemagglutinin (HA) | U37170.1 |
| A/Chicken/Mexico/31381-Avilab/94(H5N2)hemagglutinin (HA) | L46585.1 |
| A/chicken/Mexico/31382-1/1994(H5N2)hemagglutinin (HA) | U37168.1 |
| A/chicken/Mexico/31381-2/1994(H5N2) hemagglutinin (HA) | U37167.1 |
| A/chicken/Mexico/31381-1/1994(H5N2) hemagglutinin (HA) | U37166.1 |
| A/chicken/Mexico/31381-7/1994(H5N2) hemagglutinin (HA) | U37165.1 |
| A/chicken/Pennsylvania/13609/1993(H5N2) hemagglutinin | U05331.1 |
| A/chicken/Pennsylvania/1/1983(H5N2) hemagglutinin esterase precursor | M18001.1 |
| A/chicken/Pennsylvania/1370/1983(H5N2) hemagglutinin esterase precursor | M10243.1 |
| A/Chicken/Puebla/8623-607/94(H5N2) hemagglutinin (HA) | L46586.1 |
| A/chicken/Puebla/14586-654/1994(H5N2) hemagglutinin (HA) | U37180.1 |
| A/chicken/Puebla/14585-622/1994(H5N2) hemagglutinin (HA) | U37179.1 |
| A/chicken/Puebla/8623-607/1994(H5N2)hemagglutinin (HA) | U37178.1 |
| A/chicken/Puebla/8624-604/1994(H5N2) hemagglutinin (HA) | U37177.1 |
| A/Chicken/Queretaro/14588-19/95(H5N2) hemagglutinin (HA) | L46587.1 |
| A/chicken/Queretaro/7653-20/95(H5N2) hemagglutinin (HA) | U79448.1 |
| A/chicken/Queretaro/26654-1373/1994(H5N2) hemagglutinin (HA) | U37171.1 |
| A/chicken/Queretaro/14588-19/1994(H5N2)hemagglutinin (HA) | U37182.1 |
| A/chicken/Singapore/98(H5N2) matrix protein 2 (M2) | EF682127.1 |
| A/chicken/Taiwan/1209/03(H5N2) hemagglutinin protein (HA) | AY573917.1 |
| A/chicken/Taiwan/1209/03(H5N2) neuraminidase | AY573918.1 |
| A/duck/Eastern China/64/2004(H5N2) segment 6 neuraminidase (NA) | EU429791.1 |
| A/duck/Eastern China/264/2002(H5N2) segment 6 neuraminidase (NA) | EU429744.1 |
| A/duck/Eastern China/01/2001(H5N2) segment 6 neuraminidase (NA) | EU429728.1 |
| A/duck/Eastern China/06/2000(H5N2) segment 6 neuraminidase (NA) | EU429722.1 |
| A/duck/Hong Kong/342/78(H5N2) matrix protein 1 (M) and matrix protein 2 (M) | DQ107452.1 |
| A/duck/Hong Kong/342/78(H5N2) hemagglutinin precursor | U20475.1 |
| A/duck/Michigan/80(H5N2) hemagglutinin 1 chain | U20474.1 |
| A/duck/Michigan/80(H5N2) hemagglutinin | U79449.1 |
| A/duck/MN/1564/81(H5N2) matrix protein 1 (M) and matrix protein 2 (M) | DQ107467.1 |
| A/duck/Mongolia/54/2001(H5N2) hemagglutinin (HA) | AB241614.2 |
| A/duck/Primorie/2621/01(H5N2) hemagglutinin (HA) | AJ621811.3 |
| A/duck/Primorie/2621/01(H5N2)nucleoprotein (NP) | AJ621812.1 |
| A/duck/Primorie/2621/01(H5N2) nonstructural protein (NS) | AJ621813.1 |
| A/duck/Pennsylvania/84(H5N2) hemagglutinin 1chain | U20473.1 |
| A/duck/Potsdam/1402-6/86(H5N2) hemagglutinin H5 | AF082042.1 |
| A/emu/Texas/39442/93(H5N2) hemaglutinin | U28920.1 |
| A/emu/Texas/39442/93(H5N2) hemaglutinin | U28919.1 |
| A/mallard/Alberta/645/80(H5N2) matrix protein 1 (M) and matrix protein 2 (M) | DQ107471.1 |
| A/mallard/AR/1C/2001(H5N2) matrix protein 1 (M) and matrix protein 2 (M) | DQ107463.1 |

TABLE 11-continued

Other Influenza A Antigens (H4N*-H13N*)

| Strain/Protein | GenBank Access No. |
|---|---|
| A/mallard/NY/189/82(H5N2) matrix protein 1 (M) and matrix protein 2 (M) | DQ107465.1 |
| A/mallard/MN/25/80(H5N2) matrix protein 1 (M) and matrix protein 2 (M) | DQ107473.1 |
| A/mallard/MI/18/80(H5N2) matrix protein 1 (M) and matrix protein 2 (M) | DQ107470.1 |
| A/mallard/Ohio/345/88(H5N2) hemagglutinin | U79450.1 |
| A/parrot/CA/6032/04(H5N2) polymerase basic protein 2 (PB2) | DQ256390.1 |
| A/parrot/CA/6032/04(H5N2) polymerase basic protein 1 (PB1) | DQ256389.1 |
| A/parrot/CA/6032/04(H5N2) matrix protein (M) | DQ256384.2 |
| A/parrot/CA/6032/04(H5N2) hemagglutinin (HA) | DQ256383.1 |
| A/parrot/CA/6032/04(H5N2) neuraminidase (NA) | DQ256385.1 |
| A/parrot/CA/6032/04(H5N2) polymerase basic protein 2 (PB2) | DQ256390.1 |
| A/parrot/CA/6032/04(H5N2) nucleoprotein (NP) | DQ256386.1 |
| A/parrot/CA/6032/04(H5N2)) polymerase (PA) | DQ256388.1 |
| A/ruddy turnstone/Delaware/244/91 (H5N2) nonfunctional matrix protein | AY664474.1 |
| A/ruddy turnstone/Delaware/244/91 (H5N2) | U05330.1 |
| A/turkey/Colorado/72(H5N2) hemagglutinin 1 chain (HA) | U20472.1 |
| A/turkey/England/N28/73 (H5N2) hemagglutinin | AY500365.1 |
| A/turkey/TX/14082/81(H5N2) matrix protein 1 (M) and matrix protein 2 (M) | DQ107464.1 |
| A/turkey/MN/1704/82(H5N2)) matrix protein 1 (M) and matrix protein 2 (M) | DQ107472.1 |
| A/turkey/Minnesota/10734/95(H5N2)) hemagglutinin | U79455.1 |
| A/turkey/Minnesota/3689-1551/81(H5N2) hemagglutinin | U79454.1 |
| A/chicken/Singapore/1997(H5N3) M2 protein | EU014141.1 |
| A/duck/Hokkaido/299/04(H5N3) hemagglutinin (HA) | AB241626.1 |
| A/duck/Hokkaido/193/04(H5N3) hemagglutinin (HA) | AB241625.1 |
| A/duck/Hokkaido/101/04(H5N3) hemagglutinin (HA) | AB241624.1 |
| A/duck/Hokkaido/447/00(H5N3) hemagglutinin (HA) | AB241620.1 |
| A/duck/Hokkaido/69/00(H5N3) hemagglutinin (HA) | AB241619.1 |
| A/duck/Hong Kong/205/77(H5N3) hemagglutinin H5 | AF082038.1 |
| A/duck/Hong Kong/698/79(H5N3) hemagglutinin H5 | AF082039.1 |
| A/duck/Hong Kong/308/78(H5N3) matrix protein 1 (M) and matrix protein 2 (M) | DQ107457.1 |
| A/duck/Hong Kong/825/80(H5N3) matrix protein 1 (M) and matrix protein 2 (M) | DQ107455.1 |
| A/duck/Hong Kong/820/80(H5N3) matrix protein 1 (M) and matrix protein 2 (M) | DQ107453.1 |
| A/duck/Hong Kong/205/77(H5N3) matrix protein 1 (M) and matrix protein 2 (M) | DQ107456.1 |
| A/Duck/Ho Chi Minh/014/78(H5N3) segment 4 hemagglutinin | AF290443.1 |
| A/duck/Jiangxi/6151/2003(H5N3) matrix protein 1 (M) and matrix protein 2 (M) | DQ107451.1 |
| A/duck/Malaysia/F119-3/97(H5N3) hemagglutinin | AF303057.1 |
| A/duck/Miyagi/54/76(H5N3)hemagglutinin (HA) | AB241615.1 |
| A/duck/Mongolia/596/01(H5N3) hemagglutinin HA) | AB241622.1 |
| A/duck/Mongolia/500/01(H5N3)hemagglutinin (HA) | AB241621.1 |
| A/duck/Primorie/2633/01(H5N3) matrix protein (M1) | AJ621810.1 |
| A/duck/Primorie/2633/01(H5N3)nucleoprotein (NP) | AJ621808.1 |
| A/duck/Primorie/2633/01(H5N3)hemagglutinin (HA) | AJ621807.1 |
| A/duck/Primorie/2633/01(H5N3)nucleoprotein (NP) | AJ621809.1 |
| A/goose/Hong Kong/23/78(H5N3) matrix protein 1 (M) and matrix protein 2 (M) | DQ107454.1 |
| A/mallard/Wisconsin/169/75(H5N3) hemagglutinin | U79452.1 |
| A/swan/Hokkaido/51/96(H5N3)hemagglutinin (HA) | AB241617.1 |
| A/swan/Hokkaido/4/96(H5N3) hemagglutinin (HA) | AB241616.1 |
| A/turkey/CA/6878/79(H5N3) matrix protein 1 (M) and matrix protein 2 (M) | DQ107469.1 |
| A/tern/South Africa/61(H5N3) hemagglutinin precursor (HA) | U20460.1 |
| A/gull/Delaware/5/2000(H5N4) matrix protein 1 (M) and matrix protein 2 (M) | DQ107459.1 |
| A/gull/Delaware/4/2000(H5N4) matrix protein 1 (M) and matrix protein 2 (M) | DQ107458.1 |
| A/shorebird/Delaware/109/2000(H5N4) matrix protein 1 (M) | DQ107460.1 |
| A/shorebird/Delaware/243/2000(H5N4) matrix protein 1 (M) and matrix protein 2 (M) | DQ107462.1 |
| A/shorebird/Delaware/230/2000(H5N4) matrix protein 1 (M) and matrix protein 2 (M) | DQ107461.1 |
| A/mallard/Wisconsin/34/75(H5N6) hemagglutinin | U79451.1 |
| A/duck/Potsdam/2216-4/1984(H5N6) hemagglutinin H5 | AF082041.1 |
| A/shorebird/Delaware/207/98 (H5N8) nonfunctional matrix protein | AY664456.1 |
| A/shorebird/Delaware/27/98 (H5N8) nonfunctional matrix protein | AY664453.1 |

TABLE 11-continued

Other Influenza A Antigens (H4N*-H13N*)

| Strain/Protein | GenBank Access No. |
|---|---|
| A/herring gull/Delaware/281/98 (H5N8) nonfunctional matrix protein | AY664452.1 |
| A/mallard/Ohio/556/1987(H5N9) hemagglutinin (HA) | U67783.2 |
| A/turkey/Wisconsin/68(H5N9) hemagglutinin | U79456.1 |
| A/blue-winged teal/Alberta/685/82(H6N1) matrix protein 1 (M) and matrix protein 2 (M) | DQ107448.1 |
| A/chicken/Taiwan/7-5/99(H6N1) nucleocapsid protein (NP) | AF261750.1 |
| A/chicken/Taiwan/7-5/99(H6N1) matrix protein | AF262213.1 |
| A/chicken/Taiwan/7-5/99(H6N1) nonstructural protein | AF262212.1 |
| A/chicken/Taiwan/7-5/99(H6N1) polymerase (PA) | AF262211.1 |
| A/chicken/Taiwan/7-5/99(H6N1) polymerase subunit PB1 | AF262210.1 |
| A/chicken/Taiwan/7-5/99(H6N1) nucleocapsid protein (NP) | AF261750.1 |
| A/chicken/Taiwan/ns2/99(H6N1) segment 4 hemagglutinin (HA1) | AF310985.1 |
| A/chicken/Taiwan/na3/98(H6N1) segment 4 hemagglutinin (HA1) | AF310984.1 |
| A/chicken/Taiwan/7-5/99(H6N1) segment 4 hemagglutinin (HA1) | AF310983.1 |
| A/duck/Hong Kong/D73/76(H6N1) matrix protein 1 (M) and matrix protein 2 (M) | DQ107432.1 |
| A/duck/Taiwan/9/23-3/2000(H6N1) matrix protein 1 (M) and matrix protein 2 (M) | DQ107407.1 |
| A/pheasant/Hong Kong/FY479/2000(H6N1) matrix protein 1 (M) and matrix protein 2 (M) | DQ107409.1 |
| A/pheasant/Hong Kong/SSP44/2002(H6N1) matrix protein 1 (M) and matrix protein 2 (M) | DQ107412.1 |
| A/quail/Hong Kong/YU421/2002(H6N1) matrix protein 1 (M) and matrix protein 2 (M) | DQ107414.1 |
| A/avian/NY/17150-7/2000(H6N2) matrix protein 1 (M) and matrix protein 2 (M) | DQ107423.1 |
| A/chicken/CA/285/2003(H6N2) matrix protein 1 (M) and matrix protein 2 (M) | DQ107429.1 |
| A/chicken/CA/375TR/2002(H6N2) matrix protein 1 (M) and matrix protein 2 (M) | DQ107428.1 |
| A/chicken/CA/203/2003(H6N2) matrix protein 1 (M) and matrix protein 2 (M) | DQ107426.1 |
| A/chicken/NY/101250-7/2001(H6N2) matrix protein 1 (M) and matrix protein 2 (M) | DQ107419.1 |
| A/chicken/CA/625/2002(H6N2) matrix protein 1 (M) and matrix protein 2 (M) | DQ107418.1 |
| A/Chicken/California/0139/2001(H6N2)nucleoprotein (NP) | AF474070.1 |
| A/Chicken/California/650/2000(H6N2) nucleoprotein (NP) | AF474069.1 |
| A/Chicken/California/9420/2001(H6N2) neuraminidase N2 (N2) | AF474048.1 |
| A/Chicken/California/9174/2001(H6N2) neuraminidase N2 (N2) | AF474047.1 |
| A/Chicken/California/8892/2001(H6N2)neuraminidase N2 (N2) | AF474046.1 |
| A/Chicken/California/6643/2001(H6N2) neuraminidase N2 (N2) | AF474045.1 |
| A/Chicken/California/1316/2001(H6N2)neuraminidase N2 (N2) | AF474044.1 |
| A/Chicken/California/0139/2001(H6N2) neuraminidase N2 (N2) | AF474043.1 |
| A/Chicken/California/1002/2000(H6N2) neuraminidase N2 (N2) | AF474042.1 |
| A/Chicken/California/650/2000(H6N2) neuraminidase N2 (N2) | AF474041.1 |
| A/Chicken/California/465/2000(H6N2) neuraminidase N2 (N2) | AF474040.1 |
| A/Chicken/California/431/2000(H6N2) neuraminidase N2 (N2) | AF474039.1 |
| A/Chicken/California/6643/2001(H6N2) hemagglutinin H6 (H6) | AF474035.1 |
| A/Chicken/California/431/2000(H6N2) hemagglutinin H6 (H6) | AF474029.1 |
| A/Chicken/California/9420/2001(H6N2) hemagglutinin H6 (H6) | AF474038.1 |
| A/Chicken/California/9174/2001(H6N2) hemagglutinin H6 (H6) | AF474037.1 |
| A/Chicken/California/8892/2001(H6N2) hemagglutinin H6 (H6) | AF474036.1 |
| A/Chicken/California/1316/2001(H6N2) hemagglutinin H6 (H6) | AF474034.1 |
| A/Chicken/California/0139/2001(H6N2) hemagglutinin H6 (H6) | AF474033.1 |
| A/Chicken/California/1002/2000(H6N2) hemagglutinin H6 (H6) | AF474032.1 |
| A/Chicken/California/650/2000(H6N2) hemagglutinin H6 (H6) | AF474031.1 |
| A/Chicken/California/465/2000(H6N2) hemagglutinin H6 (H6) | AF474030.1 |
| A/cornish cross/CA/139/2001(H6N2) matrix protein 1 (M) and matrix protein 2 (M) | DQ107424.1 |
| A/duck/Eastern China/164/2002(H6N2) segment 6 neuraminidase (NA) | EU429762.1 |
| A/duck/Eastern China/729/2003(H6N2) segment 6 neuraminidase (NA) | EU429760.1 |
| A/duck/Eastern China/262/2002(H6N2) segment 6 neuraminidase (NA) | EU429743.1 |
| A/duck/Eastern China/74/2006(H6N2) segment 6 neuraminidase (NA) | EU429741.1 |
| A/duck/Eastern China/161/2002(H6N2) segment 6 neuraminidase (NA) | EU429740.1 |
| A/duck/Hong Kong/960/80(H6N2)) matrix protein 1 (M) and matrix protein 2 (M) | DQ107435.1 |
| A/duck/Hong Kong/D134/77(H6N2)) matrix protein 1 (M) and matrix protein 2 (M) | DQ107433.1 |

TABLE 11-continued

| Other Influenza A Antigens (H4N*-H13N*) | |
|---|---|
| Strain/Protein | GenBank Access No. |
| A/duck/CA/10221/2002(H6N2) matrix protein 1 (M) and matrix protein 2 (M) | DQ107421.1 |
| A/duck/Shantou/5540/2001(H6N2) matrix protein 1 (M) and matrix protein 2 (M) | DQ107431.1 |
| A/guinea fowl/Hong Kong/SSP99/2002(H6N2) matrix protein 1 (M) and matrix protein 2 (M) | DQ107413.1 |
| A/mallard/NY/016/83(H6N2) matrix protein 1 (M) and matrix protein 2 (M) | DQ107449.1 |
| A/mallard/NY/046/83(H6N2) matrix protein 1 (M) and matrix protein 2 (M) | DQ107450.1 |
| A/pintail/Alberta/644/81(H6N2) matrix protein 1 (M) and matrix protein 2 (M) | DQ107445.1 |
| A/quail/Hong Kong/SF792/2000(H6N2) matrix protein 1 (M) and matrix protein 2 (M) | DQ107410.1 |
| A/ruddy turnstone/Delaware/106/98 (H6N2) nonfunctional matrix protein | AY664439.1 |
| A/Shorebird/Delaware/127/97(H6N2) nonfunctional matrix protein | AY664467.1 |
| A/shorebird/Delaware/124/2001(H6N2) matrix protein 1 (M) and matrix protein 2 (M) | DQ107417.1 |
| A/shorebird/Delaware/208/2001(H6N2) matrix protein 1 (M) and matrix protein 2 (M) | DQ107427.1 |
| A/turkey/CA/527/2002(H6N2) matrix protein 1 (M) and matrix protein 2 (M) | DQ107420.1 |
| A/turkey/CA/1623CT/2002(H6N2) matrix protein 1 (M) and matrix protein 2 (M) | DQ107425.1 |
| A/turkey/MN/836/80(H6N2) matrix protein 1 (M) and matrix protein 2 (M) | DQ107440.1 |
| A/turkey/MN/735/79(H6N2) matrix protein 1 (M) and matrix protein 2 (M) | DQ107437.1 |
| A/chicken/Hong Kong/17/77(H6N4)) matrix protein 1 (M) and matrix protein 2 (M) | DQ107436.1 |
| A/chicken/Hong Kong/CSW106/2001(H6N4) matrix protein 1 (M) and matrix protein 2 (M) | DQ107406.1 |
| A/gull/Delaware/18/2000(H6N4) matrix protein 1 (M) and matrix protein 2 (M) | DQ107415.1 |
| A/pheasant/Hong Kong/CSW2573/2001(H6N4) matrix protein 1 (M) and matrix protein 2 (M) | DQ107411.1 |
| A/quail/Hong Kong/CSW106/2001(H6N4) matrix protein 1 (M) and matrix protein 2 (M) | DQ107430.1 |
| A/Shorebird/Delaware/194/98(H6N4) nonfunctional matrix protein | AY664424.1 |
| A/shorebird/Delaware/259/2000(H6N4) matrix protein 1 (M) and matrix protein 2 (M) | DQ107416.1 |
| A/shearwater/Australia/1/1972(H6N5) segment 6 neuraminidase (NA) | EU429794.1 |
| A/shearwater/Australia/1/1972(H6N5) polymerase A (PA) | L25832.1 |
| A/pintail/Alberta/1040/79(H6N5) matrix protein 1 (M) and matrix protein 2 (M) | DQ107439.1 |
| A/blue-winged teal/MN/993/80(H6N6)) matrix protein 1 (M) and matrix protein 2 (M) | DQ107441.1 |
| A/duck/NY/83779/2002(H6N6) matrix protein 1 (M) and matrix protein 2 (M) | DQ107422.1 |
| A/duck/MN/1414/81(H6N6) matrix protein 1 (M) and matrix protein 2 (M) | DQ107444.1 |
| A/mallard/Alberta/289/82(H6N6) matrix protein 1 (M) and matrix protein 2 (M) | DQ107447.1 |
| A/mallard duck/MN/1041/80(H6N6) matrix protein 1 (M) and matrix protein 2 (M) | DQ107442.1 |
| A/pintail/Alberta/189/82(H6N6) matrix protein 1 (M) and matrix protein 2 (M) | DQ107446.1 |
| A/sanderling/Delaware/1258/86(H6N6) nonfunctional matrix protein | AY664436.1 |
| A/blue-winged teal/Alberta/368/78(H6N8)) matrix protein 1 (M) and matrix protein 2 (M) | DQ107438.1 |
| A/ruddy turnstone/Delaware/105/98 (H6N8) nonfunctional matrix protein | AY664428.1 |
| A/domestic duck/NY/81(H6N8)) matrix protein (M) | DQ107443.1 |
| A/duck/Eastern China/163/2002(H6N8) segment 6 neuraminidase (NA) | EU429786.1 |
| A/duck/Hong Kong/D182/77(H6N9) matrix protein 1 (M) and matrix protein 2 (M) | DQ107434.1 |
| A/chicken/Hong Kong/SF3/2001(H6) matrix protein 1 (M) and matrix protein 2 (M) | DQ107408.1 |
| A/African starling/England/983/79(H7N1) neuraminidase (N1) | AJ416629.1 |
| A/Afri.Star./Eng-Q/938/79(H7N1) hemagglutinin precurosr | AF149295.1 |
| A/chicken/Italy/1067/99(H7N1) matrix protein 1 (M1) | AJ416630.1 |

TABLE 11-continued

| Other Influenza A Antigens (H4N*-H13N*) | |
|---|---|
| Strain/Protein | GenBank Access No. |
| A/chicken/Italy/1067/99(H7N1) neuraminidase (N1) | AJ416627.1 |
| A/chicken/Italy/4575/99 (H7N1) hemagglutinin (HA) | AJ493469.1 |
| A/chicken/Italy/13474/99(H7N1) haemagglutinin (HA) | AJ491720.1 |
| A/chicken/Italy/445/1999(H7N1) | AX537385.1 |
| A/Chicken/Italy/267/00(H7N1) hemagglutinin (HA) | AJ493215.1 |
| A/Chicken/Italy/13489/99(H7N1) hemagglutinin (HA) | AJ493214.1 |
| A/Chicken/Italy/13307/99(H7N1) hemagglutinin (HA) | AJ493212.1 |
| A/chicken/Singapore/1994(H7N1) M2 protein | EU014140.1 |
| A/duck/Hong Kong/301/78(H7N1) matrix protein 1 (M) and matrix protein 2 (M) | DQ107475.1 |
| A/Hong Kong/301/78(H7N1) hemagglutinin (HA) | AY672090.1 |
| A/fowl plaguq virus/Rostock/34 (H7N1) NP protein | AJ243993.1 |
| A/fowl plaguq virus/Rostock/34 (H7N1) PA protein | AJ243992.1 |
| A/fowl plaguq virus/Rostock/34 (H7N1) PB2 protein | AJ243991.1 |
| A/fowl plaguq virus/Rostock/34 (H7N1) PB1 protein | AJ243990.1 |
| A/ostrich/South Africa/5352/92(H7N1) hemagglutinin precursor (HA) | U20458.1 |
| A/rhea/North Carolina/39482/93(H7N1) hemagglutinin precursor (HA) | U20468.1 |
| A/turkey/Italy/3775/99 (H7N1) hemagglutinin (HA) | AJ493472.1 |
| A/turkey/Italy/4603/99 (H7N1) hemagglutinin (HA) | AJ493471.1 |
| A/turkey/Italy/4602/99 (H7N1) hemagglutinin (HA) | AJ493470.1 |
| A/turkey/Italy/4169/99 (H7N1) hemagglutinin (HA) | AJ493468.1 |
| A/turkey/Italy/4073/99 (H7N1) hemagglutinin (HA) | AJ493467.1 |
| A/turkey/Italy/3889/99 (H7N1) hemagglutinin (HA) | AJ493466.1 |
| A/turkey/Italy/12598/99(H7N1) haemagglutinin (HA) | AJ489520.1 |
| A/turkey/Italy/4580/99(H7N1) haemagglutinin (HA) | AJ416628.1 |
| A/Turkey/Italy/335/00(H7N1) haemagglutinin (HA) | AJ493217.1 |
| A/Turkey/Italy/13468/99(H7N1) haemagglutinin (HA) | AJ493216.1 |
| A/Turkey/Italy/13467/99(H7N1) haemagglutinin (HA) | AJ493213.1 |
| A/chicken/CT/9407/2003(H7N2) matrix protein 1 (M) and matrix protein 2 (M) | DQ107478.1 |
| A/chicken/NY/116124/2003(H7N2) matrix protein 1 (M) and matrix protein 2 (M) | DQ107479.1 |
| A/chicken/PA/143586/2002(H7N2) matrix protein 1 (M) and matrix protein 2 (M) | DQ107477.1 |
| A/duck/Hong Kong/293/78(H7N2) matrix protein 1 (M) and matrix protein 2 (M) | DQ107474.1 |
| A/duck/Hong Kong/293/78(H7N2) hemagglutinin precursor (HA) | U20461.1 |
| A/laughing gull/Delaware/2838/87 (H7N2) nonfunctional matrix protein | AY664427.1 |
| A/pheasant/NJ/30739-9/2000(H7N2) matrix protein 1 (M) and matrix protein 2 (M) | DQ107481.1 |
| A/ruddy turnstone/Delaware/130/99 (H7N2) onfunctional matrix protein | AY664451.1 |
| A/unknown/149717-12/2002(H7N2) matrix protein 1 (M) and matrix protein 2 (M) | DQ107480.1 |
| A/unknown/NY/74211-5/2001(H7N2) matrix protein 1 (M) and matrix protein 2 (M) | DQ107476.1 |
| A/unknown/149717-12/2002(H7N2) matrix protein 1 (M) and matrix protein 2(M) | DQ107480.1 |
| A/unknown/NY/74211-5/2001(H7N2) matrix protein 1(M) and matrix protein 2 (M) | DQ107476.1 |
| A/chicken/British Columbia/CN7-3/04 (H7N3) hemagglutinin (HA) | AY644402.1 |
| A/chicken/British Columbia/CN7-3/04 (H7N3) matrix protein (M1) | AY677732.1 |
| A/chicken/Italy/270638/02(H7N3) hemagglutinin (HA) | EU158111.1 |
| A/gadwall/MD/3495/83(H7N3) matrix protein 1 (M) and matrix protein 2 (M) | DQ107488.1 |
| A/mallard/Alberta/22/2001(H7N3) matrix protein 1 (M) and matrix protein 2 (M) | DQ107482.1 |
| A/mallard/Alberta/699/81(H7N3) matrix protein 1 (M) and matrix protein 2 (M) | DQ107487.1 |
| A/pintail/Alberta/25/2001(H7N3) matrix protein 1 (M) and matrix protein 2 (M) | DQ107483.1 |
| A/Quail/Arkansas/16309-7/94 (H7N3) hemagglutinin protein subunit 1 precursor (HA1) | AF072401.1 |
| A/ruddy turnstone/New Jersey/65/85(H7N3) nonfunctional matrix protein | AY664433.1 |
| A/turkey/England/63(H7N3) hemagglutinin precursor (HA) | U20462.1 |
| A/Turkey/Colorado/13356/91 (H7N3) hemagglutinin protein subunit 1 precursor (HA1) | AF072400.1 |
| A/turkey/MN/1200/80(H7N3)) matrix protein 1 (M) and matrix protein 2 (M) | DQ107486.1 |
| A/turkey/MN/1818/82(H7N3) matrix protein 1 (M) and matrix protein 2 (M) | DQ107489.1 |

TABLE 11-continued

Other Influenza A Antigens (H4N*-H13N*)

| Strain/Protein | GenBank Access No. |
|---|---|
| A/turkey/Minnesota/1237/80(H7N3) hemagglutinin precursor (HA) | U20466.1 |
| A/turkey/TX/1/79(H7N3) matrix protein 1 (M) and matrix protein 2 (M) | DQ107484.1 |
| A/Turkey/Oregon/71(H7N3) hemagglutinin | AF497557.1 |
| A/Turkey/Utah/24721-10/95 (H7N3) hemagglutinin protein subunit 1 precursor (HA1) | AF072402.1 |
| A/softbill/South Africa/142/92(H7N4) hemagglutinin precursor (HA) | U20464.1 |
| A/ruddy turnstone/Delaware/2770/87 (H7N5) nonfunctional matrix protein | AY664476.1 |
| A/chicken/Brescia/1902(H7N7) hemagglutinin 1 chain (HA) | U20471.1 |
| A/chicken/Jena/1816/87(H7N7) hemagglutinin precursor (HA) | U20469.1 |
| A/chicken/Leipzig/79(H7N7) hemagglutinin precursor (HA) | U20459.1 |
| A/duck/Heinersdorf/S495/6/86(H7N7) hemagglutinin precursor (HA) | U20465.1 |
| A/equine/Prague/1/56 (H7N7) neuraminidase | U85989.1 |
| A/equine/Santiago/77(H7N7) nucleoprotein | AY383752.1 |
| A/equine/Santiago/77(H7N7) neuraminidase | AY383757.1 |
| A/equine/Santiago/77(H7N7) hemagglutinin | AY383756.1 |
| A/FPV/Weybridge(H7N7) matrix protein | M38299.1 |
| A/goose/Leipzig/187/7/1979(H7N7) hemagglutinin | L43914.1 |
| A/goose/Leipzig/192/7/1979(H7N7) hemagglutinin | L43915.1 |
| A/goose/Leipzig/137/8/1979(H7N7) hemagglutinin | L43913.1 |
| A/ruddy turnstone/Delaware/134/99 (H7N7) nonfunctional matrix protein | AY664468.1 |
| A/seal/Mass/1/80 H7N7 recombinant | S73497.1 |
| A/swan/Potsdam/63/6/81(H7N7) hemagglutinin precursor (HA) | U20467.1 |
| A/tern/Potsdam/342/6/79(H7N7) hemagglutinin precursor (HA) | U20470.1 |
| A/pintail/Alberta/121/79(H7N8) matrix protein 1 (M) and matrix protein 2 (M) | DQ107485.1 |
| A/Turkey/Minnesota/38429/88(H7N9) hemagglutinin | AF497551.1 |
| A/turkey/Ontario/6118/1968(H8N4) segment 6 neuraminidase (NA) | EU429793.1 |
| A/Mallard Duck/Alberta/357/84(H8N4) segment 4 hemagglutinin (HA1) | AF310988.1 |
| A/Pintail Duck/Alberta/114/79(H8N4) segment 4 hemagglutinin (HA1) | AF310987.1 |
| A/duck/Eastern China/01/2005(H8N4) segment 6 neuraminidase (NA) | EU429780.1 |
| A/Red Kont/Delaware/254/94(H8N4) segment 4 hemagglutinin (HA1) | AF310989.1 |
| A/chicken/Amioz/1527/03(H9N2) nucleoprotein | DQ116511.1 |
| A/chicken/Amioz/1527/03(H9N2) neuraminidase | DQ116081.1 |
| A/chicken/Amioz/1527/03(H9N2) hemagglutinin | DQ108911.1 |
| A/chicken/Alonim/1953/104(H9N2) hemagglutinin | DQ108928.1 |
| A/chicken/Alonim/1552/03(H9N2) hemagglutinin | DQ108914.1 |
| A/chicken/Alonim/1552/03(H9N2) nucleoprotein | DQ116514.1 |
| A/chicken/Alonim/1965/04(H9N2) hemagglutinin | DQ108929.1 |
| A/Chicken/Anhui/1/98(H9N2) hemagglutinin (HA) | AF461511.1 |
| A/Chicken/Beijing/1/95(H9N2) nonfunctional matrix protein | AF536719.1 |
| A/Chicken/Beijing/1/95(H9N2) nucleoprotein (NP) | AF536699.1 |
| A/Chicken/Beijing/1/95(H9N2) nonfunctional nonstructural protein | AF536729.1 |
| A/Chicken/Beijing/1/95(H9N2) segment 6 neuraminidase (NA) | AF536709.1 |
| A/Chicken/Beijing/2/97(H9N2) nucleoprotein (NP) | AF536700.1 |
| A/Chicken/Beijing/2/97(H9N2) nonfunctional matrix protein | AF536720.1 |
| A/Chicken/Beijing/2/97(H9N2) nonfunctional nonstructural protein | AF536730.1 |
| A/Chicken/Beijing/2/97(H9N2) segment 6 neuraminidase (NA) | AF536710.1 |
| A/Chicken/Beijing/1/97(H9N2) hemagglutinin (HA) | AF461530.1 |
| A/Chicken/Beijing/3/99(H9N2) nonfunctional matrix protein | AF536721.1 |
| A/Chicken/Beijing/3/99(H9N2) nucleoprotein (NP) | AF536701.1 |
| A/Chicken/Beijing/3/99(H9N2) nonfunctional nonstructural protein | AF536731.1 |
| A/Chicken/Beijing/3/99(H9N2) segment 6 neuraminidase (NA) | AF536711.1 |
| A/chicken/Beit Alfa/1282/03(H9N2)hemagglutinin | DQ104476.1 |
| A/chicken/Beit-Aran/29/05(H9N2) hemagglutinin | DQ108931.1 |
| A/chicken/Bnei Darom/1557/03(H9N2) hemagglutinin | DQ108915.1 |
| A/chicken/Ein Habsor/1808/04(H9N2) hemagglutinin | DQ108925.1 |
| A/Chicken/Gangxi/2/00(H9N2) hemagglutinin (HA) | AF461514.1 |
| A/Chicken/Gangxi/1/00(H9N2) hemagglutinin (HA) | AF461513.1 |
| A/chicken/Gan Shomron/1465/03(H9N2) hemagglutinin | DQ104480.1 |
| A/chicken/Gan Shomron/1292/03(H9N2) hemagglutinin | DQ104478.1 |
| A/chicken/Gan_Shomron/1465/03(H9N2) nucleoprotein | DQ116506.1 |
| A/chicken/Gan_Shomron/1465/03(H9N2) neuraminidase | DQ116077.1 |
| A/chicken/Gan Shomron/1543/04(H9N2) nucleoprotein | DQ116512.1 |
| A/chicken/Gan Shomron/1543/04(H9N2) hemagglutinin | DQ108912.1 |
| A/Chicken/Guangdong/97(H9N2) nonfunctional matrix protein | AF536722.1 |
| A/Chicken/Guangdong/97(H9N2) nucleoprotein (NP) | AF536702.1 |

TABLE 11-continued

| Other Influenza A Antigens (H4N*-H13N*) | |
|---|---|
| Strain/Protein | GenBank Access No. |
| A/Chicken/Guangdong/97(H9N2) nonfunctional nonstructural protein | AF536732.1 |
| A/Chicken/Guangdong/97(H9N2) segment 6 neuraminidase (NA) | AF536712.1 |
| A/Chicken/Gansu/1/99(H9N2) hemagglutinin (HA) | AF461512.1 |
| A/chicken/Gujrat/India/3697/2004(H9N2) polymerase basic 2 (PB2) | DQ979865.1 |
| A/chicken/Haryana/India/2424/2004(H9N2) polymerase basic 2 (PB2) | DQ979862.1 |
| A/Chicken/Henan/98(H9N2) nonfunctional matrix protein | AF536726.1 |
| A/Chicken/Henan/98(H9N2) nucleoprotein (NP) | AF536706.1 |
| A/Chicken/Henan/98(H9N2) nonfunctional nonstructural protein | AF536736.1 |
| A/Chicken/Henan/2/98(H9N2) hemagglutinin (HA) | AF461517.1 |
| A/Chicken/Henan/1/99(H9N2) hemagglutinin (HA) | AF461516.1 |
| A/Chicken/Henan/98(H9N2) segment 6 neuraminidase (NA) | AF536716.1 |
| A/Chicken/Hebei/1/96(H9N2) nonfunctional matrix protein | AF536723.1 |
| A/Chicken/Hebei/1/96(H9N2) segment 6 nonfunctional neuraminidase protein | AF536713.1 |
| A/Chicken/Hebei/1/96(H9N2) nucleoprotein (NP) | AF536703.1 |
| A/Chicken/Hebei/1/96(H9N2) nonfunctional nonstructural protein | AF536733.1 |
| A/Chicken/Hebei/1/96(H9N2) segment 6 nonfunctional neuraminidase protein | AF536713.1 |
| A/Chicken/Hebei/2/00(H9N2) hemagglutinin (HA) | AF461531.1 |
| A/Chicken/Hebei/2/98(H9N2) nonfunctional matrix protein | AF536724.1 |
| A/Chicken/Hebei/2/98(H9N2) nucleoprotein (NP) | AF536704.1 |
| A/Chicken/Hebei/2/98(H9N2) nonfunctional nonstructural protein | AF536734.1 |
| A/Chicken/Hebei/2/98(H9N2) segment 6 neuraminidase (NA) | AF536714.1 |
| A/Chicken/Hebei/1/00(H9N2) hemagglutinin (HA) | AF461515.1 |
| A/Chicken/Hebei/3/98(H9N2) nucleoprotein (NP) | AF536705.1 |
| A/Chicken/Hebei/3/98(H9N2) nonfunctional matrix protein | AF536725.1 |
| A/Chicken/Hebei/3/98(H9N2) nonfunctional onstructural protein | AF536735.1 |
| A/Chicken/Hebei/3/98(H9N)) segment 6 neuraminidase (NA) | AF536715.1 |
| A/chicken/Hong Kong/FY313/2000(H9N2) matrix protein 1 (M) and matrix protein 2 (M) | DQ107508.1 |
| A/chicken/Hong Kong/WF208/2001(H9N2) matrix protein 1 (M) and matrix protein 2 (M) | DQ107513.1 |
| A/chicken/Hong Kong/NT471/2002(H9N2) matrix protein 1 (M) and matrix protein 2 (M) | DQ107514.1 |
| A/chicken/Hong Kong/WF2/99(H9N2) hemagglutinin | AY206677.1 |
| A/chicken/Iarah/1376/03(H9N2) nucleoprotein | DQ116504.1 |
| A/chicken/Iarah/1376/03(H9N2) neuraminidase | DQ116075.1 |
| A/chicken/Iarah/1376/03(H9N2) hemagglutinin | DQ108910.1 |
| A/chicken/India/2793/2003(H9N2) hemagglutinin (HA) | AY336597.1 |
| A/chicken/Iran/101/1998(H9N2) matrix protein 2 (M2) | EU477375.1 |
| A/Chicken/Jiangsu/1/99(H9N)) hemagglutinin (HA) | AF461509.1 |
| A/Chicken/Jiangsu/2/98(H9N2) hemagglutinin (HA) | AF461510.1 |
| A/chicken/Kfar Monash/636/02(H9N2) hemagglutinin | DQ104464.1 |
| A/chicken/Kalanit/1966/06.12.04(H9N2) hemagglutinin | DQ108930.1 |
| A/chicken/Kaianit/1946/04(H9N2) hemagglutinin | DQ108927.1 |
| A/chicken/Korea/S4/2003(H9N2) matrix protein 1 (M) and matrix protein 2 (M) | DQ107517.1 |
| A/Chicken/Korea/MS96/96(H9N2) matrix protein 1 and 2 (M) | AF203788.1 |
| A/Chicken/Korea/MS96/96(H9N2) neuraminidase subtype 2 | AF203786.1 |
| A/Chicken/Korea/MS96/96(H9N2) nucleoprotein | AF203787.1 |
| A/Chicken/Liaoning/99(H9N2) nonfunctional matrix protein | AF536727.1 |
| A/Chicken/Liaoning/1/00(H9N2) hemagglutinin (HA) | AF461518.1 |
| A/Chicken/Liaoning/99(H9N2) nucleoprotein (NP) | AF536707.1 |
| A/Chicken/Liaoning/99(H9N2) nonfunctional matrix protein | AF536727.1 |
| A/Chicken/Liaoning/99(H9N2) nonfunctional onstructural protein | AF536737.1 |
| A/Chicken/Liaoning/2/00(H9N2) hemagglutinin (HA) | AF461519.1 |
| A/chicken/Liaoning/99(H9N2) segment 6 neuraminidase (NA) | AF536717.1 |
| A/chicken/Mudanjiang/0823/2000(H9N2) nucleoprotein (NP) | AY496851.1 |
| A/Chicken/Mudanjiang/0823/2000 (H9N2) nonstructural protein | AY631868.1 |
| A/Chicken/Mudanjiang/0823/00 (H9N2) hemagglutinin (HA) | AY513715.1 |
| A/chicken/Mudanjiang/0823/2000(H9N2) matrix protein (M1) | AY496852.1 |
| A/chicken/Mudanjiang/0823/2000(H9N2) nucleoprotein (np) | AY496851.1 |
| A/chicken/Maale HaHamisha/90658/00(H9N2) hemagglutinin | DQ104472.1 |
| A/chicken/Maanit/1477/03(H9N2) hemagglutinin | DQ104483.1 |
| A/chicken/Maanit/1291/03(H9N2) hemagglutinin | DQ104477.1 |
| A/chicken/Maanit/1275/03(H9N2) hemagglutinin | DQ104457.1 |
| A/chicken/Maanit/1477/03(H9N2) nucleoprotein | DQ116508.1 |
| A/chicken/Netohah/1373/03 (H9N2) nucleoprotein | DQ116503.1 |
| A/chicken/Netohah/1373/03 (H9N2) neuraminidase | DQ116074.1 |
| A/chicken/Netohah/1373/03 (H9N2) hemagglutinin | DQ108909.1 |
| A/chicken/Neve Ilan/1504/03(H9N2) hemagglutinin | DQ104484.1 |
| A/chicken/Neve_Ilan/1504/03(H9N2) nucleoprotein | DQ116509.1 |

TABLE 11-continued

Other Influenza A Antigens (H4N*-H13N*)

| Strain/Protein | GenBank Access No. |
|---|---|
| A/chicken/Neve_Ilan/1504/03(H9N2) neuraminidase | DQ116079.1 |
| A/chicken/Orissa/India/2317/2004(H9N2) polymerase basic 2 (PB2) | DQ979861.1 |
| A/chicken/Pardes-Hana-Carcur/1475/03(H9N2) hemagglutinin | DQ104482.1 |
| A/chicken/Pardes-Hana-Carcur/1475/03(H9N2) neuraminidase | DQ116078.1 |
| A/chicken/Saar/1456/03(H9N2) hemagglutinin | DQ104479.1 |
| A/chicken/Sde_Uziahu/1747/04(H9N2) neuraminidase | DQ116068.1 |
| A/chicken/Sede Uzziyyahu/1651/04(H9N2) hemagglutinin | DQ108923.1 |
| A/chicken/Sde Uziahu/1747/04(H9N2) | DQ108905.1 |
| A/chicken/Singapore/1998(H9N2) M2 protein | EU014142.1 |
| A/chicken/Singapore/1998(H9N2) M2 protein | EU014142.1 |
| A/Chicken/Shandong/98(H9N2) nonfunctional matrix protein | AF536728.1 |
| A/Chicken/Shandong/1/98(H9N2) hemagglutinin (HA) | AF461520.1 |
| A/Chicken/Shandong/98(H9N2) nucleoprotein (NP) | AF536708.1 |
| A/Chicken/Shandong/98(H9N2) nonfunctional nonstructural protein | AF536738.1 |
| A/Chicken/Shandong/98(H9N2) segment 6 neuraminidase (NA) | AF536718.1 |
| A/Chicken/Shandong/2/99(H9N2) hemagglutinin (HA) | AF461521.1 |
| A/chicken/Shandong/1/02(H9N2) neuraminidase (NA) | AY295761.1 |
| A/Chicken/Shanghai/F/98(H9N2) hemagglutinin | AF461532.1 |
| A/Chicken/Shanghai/1/02(H9N2) hemagglutinin | AY281745.1 |
| A/Chicken/Shanghai/2/99(H9N2)) hemagglutinin (HA) | AF461522.1 |
| A/Chicken/Shanghai/3/00(H9N2)) hemagglutinin (HA) | AF461523.1 |
| A/Chicken/Shanghai/F/98(H9N2) hemagglutinin (HA) | AY743216.1 |
| A/Chicken/Shanghai/4-2/01(H9N2) hemagglutinin (HA) | AF461525.1 |
| A/Chicken/Shanghai/4-1/01(H9N2) hemagglutinin (HA) | AF461524.1 |
| A/Chicken/Shanghai/4/01(H9N2) hemagglutinin (HA) | AY083841.1 |
| A/Chicken/Shanghai/3/01(H9N2) hemagglutinin HA) | AY083840.1 |
| A/chicken/Talmei_Elazar/1304/03(H9N2)nucleoprotein | DQ116530.1 |
| A/chicken/Talmei_Elazar/1304/03(H9N2) neuraminidase | DQ116072.1 |
| A/Chicken/Tianjing/2/96(H9N2) hemagglutinin | AF461527.1 |
| A/Chicken/Tianjing/1/96(H9N2) hemagglutinin (HA) | AF461526.1 |
| A/chicken/Tel Adashim/811/01 (H9N2) hemagglutinin | DQ104467.1 |
| A/chicken/Tel Adashim/811/01 (H9N2) nucleoprotein | DQ116527.1 |
| A/ck/Tel_Adashim/811/01 (H9N2) neuraminidase | DQ116064.1 |
| A/chicken/Tel Adashim/812/01 (H9N2) nucleoprotein | DQ116528.1 |
| A/chicken/Tel Adashim/812/01 (H9N2) hemagglutinin | DQ104468.1 |
| A/ck/Tel_Adashim/812/01(H9N2) neuraminidase | DQ116065.1 |
| A/chicken/Tel Adashim/786/01 (H9N2) nucleoprotein | DQ116524.1 |
| A/chicken/Tel Adashim/809/01 (H9N2) hemagglutinin | DQ104465.1 |
| A/chicken/Tel Adashim/809/01 (H9N2) nucleoprotein | DQ116525.1 |
| A/chicken/Tel Adashim/1469/03 (H9N2) nucleoprotein | DQ116507.1 |
| A/chicken/Tel Adashim/1469/303 (H9N2) hemagglutinin | DQ104481.1 |
| A/chicken/Tel Adashim/1506/03 (H9N2) neuraminidase | DQ116080.1 |
| A/chicken/Tel Adashim/1506/03(H9N2) hemagglutinin | DQ104474.1 |
| A/chicken/Tel Adashim/1506/03 (H9N2) nucleoprotein | DQ116510.1 |
| A/chicken/Tel Adashim/1332/03(H9N2) nucleoprotein | DQ116501.1 |
| A/chicken/Tel Adashim/1321/03(H9N2) nucleoprotein | DQ116500.1 |
| A/chicken/Tel Adashim/1332/03(H9N2) hemagglutinin | DQ108907.1 |
| A/chicken/Tel Adashim/1321/03(H9N2) hemagglutinin | DQ108906.1 |
| A/chicken/Telmond/1308/03(H9N2) nucleoprotein | DQ116499.1 |
| A/chicken/Telmond/1308/03(H9N2) neuraminidase | DQ116073.1 |
| A/chicken/Telmond/1308/03(H9N2) hemagglutinin | DQ108921.1 |
| A/chicken/Tzrofa/1568/04(H9N2) nucleoprotein | DQ116519.1 |
| A/chicken/Tzrofa/1568/04(H9N2) hemagglutinin | DQ108919.1 |
| A/chicken/UP/India/2544/2004(H9N2) polymerase basic 2 (PB2) | DQ979864.1 |
| A/chicken/UP/India/2543/2004(H9N2) polymerase basic 2 (PB2) | DQ979863.1 |
| A/chicken/Wangcheng/4/2001(H9N2) nucleoprotein | AY268949.1 |
| A/chicken/Ysodot/1362/03(H9N2) nucleoprotein | DQ116502.1 |
| A/chicken/Ysodot/1362/03(H9N2) hemagglutinin | DQ108908.1 |
| A/Chicken/Yunnan/2/00(H9N2) hemagglutinin (HA) | AF461529.1 |
| A/Chicken/Yunnan/1/99(H9N2) hemagglutinin (HA) | AF461528.1 |
| A/duck/Eastern China/01/2000(H9N2) segment 6 neuraminidase (NA) | EU429725.1 |
| A/duck/Eastern China/48/2001(H9N2) segment 6 neuraminidase (NA) | EU429707.1 |
| A/duck/Eastern China/66/2003(H9N2) segment 6 neuraminidase (NA) | EU429699.1 |
| A/duck/Eastern China/80/2004(H9N2) segment 6 neuraminidase (NA) | EU429726.1 |
| A/duck/Hong Kong/448/78(H9N2) matrix protein 1 (M) and matrix protein 2 (M) | DQ107494.1 |
| A/duck/Hong Kong/448/78(H9N2) hemagglutinin precursor | AY206673.1 |
| A/duck/Hong Kong/366/78(H9N2) hemagglutinin precursor | AY206674.1 |
| A/duck/Hong Kong/784/79(H9N2)) matrix protein 1(M) and matrix protein 2 (M) | DQ107496.1 |
| A/duck/Hong Kong/702/79(H9N2) matrix protein 1 (M) and matrix protein 2 (M) | DQ107495.1 |
| /duck/Hong Kong/702/79(H9N2) hemagglutinin precursor | AY206672.1 |
| A/duck/Hong Kong/610/79(H9N2) hemagglutinin precursor | AY206680.1 |
| A/duck/Hong Kong/552/79(H9N2) hemagglutinin precursor | AY206679.1 |

TABLE 11-continued

| Other Influenza A Antigens (H4N*-H13N*) | |
|---|---|
| Strain/Protein | GenBank Access No. |
| A/duck/Hong Kong/644/79(H9N2) hemagglutinin precursor | AY206678.1 |
| A/duck/Korea/S13/2003(H9N2) matrix protein 1 (M) and matrix protein 2 (M) | DQ107518.1 |
| A/duck/Nanchang/4-361/2001(H9N2) matrix protein 1 (M) and matrix protein 2 (M) | DQ107511.1 |
| A/duck/NY/83793/2002(H9N2) matrix protein 1 (M) and matrix protein 2 (M) | DQ107499.1 |
| A/goose/MN/5733-1243/80(H9N2) matrix protein 1 (M) and matrix protein 2 (M) | DQ107492.1 |
| A/geese/Tel Adashim/829/01(H9N2) hemagglutinin | DQ104469.1 |
| A/geese/Tel Adashim/830/01(H9N2 hemagglutinin | DQ104470.1 |
| A/ostrich/Eshkol/1436/03(H9N2) neuraminidase | DQ116076.1 |
| A/ostrich/Eshkol/1436/03(H9N2) nucleoprotein | DQ116505.1 |
| A/pigeon/Hong Kong/WF286/2000(H9N2) matrix protein 1 (M) and matrix protein 2 (M) | DQ107509.1 |
| A/quail/Hong Kong/YU415/2002(H9N2) matrix protein 1 (M) and matrix protein 2 (M) | DQ107516.1 |
| A/quail/Hong Kong/SSP225/2001(H9) matrix protein 1 (M) and matrix protein 2 (M) | DQ107512.1 |
| A/quail/Hong Kong/YU1495/2000(H9N2) matrix protein 1 (M) and matrix protein 2 (M) | DQ107510.1 |
| A/quail/Hong Kong/A28945/88(H9N2) hemagglutinin precursor | AY206675.1 |
| A/shorebird/Delaware/276/99 (H9N2) nonfunctional matrix protein | AY664464.1 |
| A/shorebird/Delaware/113/2001(H9N2) matrix protein 1 (M) and matrix protein 2 (M) | DQ107505.1 |
| A/silky chicken/Hong Kong/WF266/2002(H9N2) matrix protein 2 (M) and matrix protein 1 (M) | DQ107515.1 |
| A/shorebird/Delaware/77/2001(H9N2) matrix protein 1 (M) and matrix protein 2 (M) | DQ107497.1 |
| A/guinea fowl/Hong Kong/WF10/99(H9N2) hemagglutinin precursor | AY206676.1 |
| A/swine/Hangzhou/1/2006(H9N2) nucleocapsid protein (NP) | DQ907704.1 |
| A/swine/Hangzhou/1/2006(H9N2)) matrix protein 1 (M1) | EF055887.1 |
| A/swine/Hangzhou/1/2006(H9N2)) nonstructural protein 1 (NS1) | DQ823385.1 |
| A/Sw/ShanDong/1/2003(H9N2) hemagglutinin (HA) | AY294658.1 |
| A/turkey/CA/6889/80(H9N2) matrix protein 1 (M) and matrix protein 2 (M) | DQ107491.1 |
| A/turkey/TX/28737/81(H9N2) matrix protein 1 (M) and matrix protein 2 (M) | DQ107493.1 |
| A/turkey/MN/511/78(H9N2) matrix protein 1 (M) and matrix protein 2 (M) | DQ107490.1 |
| A/turkey/Beit Herut/1267/03(H9N2) hemagglutinin | DQ104485.1 |
| A/turkey/Beit HaLevi/1009/02(H9N2) hemagglutinin | DQ104473.1 |
| A/turkey/Beit Herut/1265/03(H9N2) hemagglutinin | DQ104456.1 |
| A/turkey/Beit__HaLevi/1562/03(H9N2) nucleoprotein | DQ116515.1 |
| A/turkey/Beit__HaLevi/1566/04(H9N2) nucleoprotein | DQ116517.1 |
| A/turkey/Beit__HaLevi/1562/03(H9N2) neuraminidase | DQ116083.1 |
| A/turkey/Beit__HaLevi/1566/04(H9N2) neuraminidase | DQ116084.1 |
| A/turkey/Beit__Herut/1267/03(H9N2) neuraminidase | DQ116070.1 |
| A/turkey/Beit__Herut/1265/03(H9N2) neuraminidase | DQ116069.1 |
| A/turkey/Beit HaLevi/1566/04(H9N2) hemagglutinin | DQ108917.1 |
| A/turkey/Bezat/89/05(H9N2) hemagglutinin | DQ108922.1 |
| A/turkey/Brosh/1276/03(H9N2) hemagglutinin | DQ104458.1 |
| A/turkey/Brosh/1276/03(H9N2) neuraminidase | DQ116071.1 |
| A/turkey/Emek Hefer/1272/03(H9N2) hemagglutinin | DQ104475.1 |
| A/turkey/Ein Habsor/1804/04(H9N2) hemagglutinin | DQ108924.1 |
| A/turkey/Ein Tzurim/1172/02(H9N2) hemagglutinin | DQ104451.1 |
| A/turkey/Ein Tzurim/1738/04(H9N2) hemagglutinin | DQ108920.1 |
| A/turkey/Ein__Tzurim/1738/04(H9N2) neuraminidase | DQ116085.1 |
| A/turkey/Gyvat Haim Ehud/1544/03(H9N2)hemagglutinin | DQ108913.1 |
| A/turkey/Givat Haim/810/01 (H9N2) hemagglutinin | DQ104466.1 |
| A/turkey/Givat Haim/810/01 (H9N2) nucleoprotein | DQ116526.1 |
| A/turkey/Givat Haim/868/02(H9N2) hemagglutinin | DQ104471.1 |
| A/turkey/Givat Haim/622/02(H9N2) hemagglutinin | DQ104462.1 |
| A/turkey/Gyvat__Haim/965/02(H9N2) nucleoprotein | DQ116498.1 |
| A/turkey/Gyvat__Haim__Ehud/1544/03(H9N2) nucleoprotein | DQ116513.1 |
| A/turkey/Gyvat__Haim__Ehud/1544/03(H9N2) neuraminidase | DQ116082.1 |
| A/tk/Givat__Haim/810/25.12.01(H9N2) neuraminidase | DQ116063.1 |
| A/turkey/Givat__Haim/622/02(H9N2)) neuraminidase | DQ116060.1 |
| A/turkey/Givat__Haim/965/02(H9N2) neuraminidase | DQ116057.1 |
| A/turkey/Hod__Ezyon/699/02(H9N2) neuraminidase | DQ116062.1 |
| A/turkey/Mishmar Hasharon/619/02 (H9N2) hemagglutinin | DQ104461.1 |
| A/turkey/Mishmar__Hasharon/619/02(H9N2) neuraminidase | DQ116059.1 |
| A/turkey/Kfar__Vitkin/616/02(H9N2) neuraminidase | DQ116058.1 |
| A/turkey/Kfar Vitkin/616/02 (H9N2) hemagglutinin | DQ104460.1 |
| A/turkey/Kfar Vitkin/615/02 (H9N2)hemagglutinin | DQ104459.1 |

TABLE 11-continued

| Other Influenza A Antigens (H4N*-H13N*) | |
|---|---|
| Strain/Protein | GenBank Access No. |
| A/turkey/Kfar Vitkin/615/02 (H9N2) nucleoprotein | DQ116520.1 |
| A/turkey/Kfar_Vitkin/616/02(H9N2)) nucleoprotein | DQ116521.1 |
| A/turkey/Kfar Warburg/1224/03(H9N2) hemagglutinin | DQ104455.1 |
| A/tk/Kfar_Vitkin/615/02(H9N) neuraminidase | DQ116067.1 |
| A/turkey/Mishmar_Hasharon/619/02(H9N2) nucleoprotein | DQ116522.1 |
| A/turkey/Naharia/1013/02(H9N2) hemagglutinin | DQ104449.1 |
| A/turkey/Nahalal/1547/04(H9N2) hemagglutinin | DQ108932.1 |
| A/turkey/Neve Ilan/90710/00 (H9N2) nucleoprotein | DQ116529.1 |
| A/tk/Neve_Ilan/90710/00(H9N2) neuraminidase | DQ116066.1 |
| A/turkey/Qevuzat_Yavne/1242/03(H9N2) neuraminidase | DQ116086.1 |
| A/turkey/Sapir/1199/02(H9N2) hemagglutinin | DQ104452.1 |
| A/turkey/Shadmot Dvorah/1567/04(H9N2) nucleoprotein | DQ116518.1 |
| A/turkey/Shadmot Dvorah/1567/04(H9N2) hemagglutinin | DQ108918.1 |
| A/turkey/Tzur Moshe/1565/04(H9N2) nucleoprotein | DQ116516.1 |
| A/turkey/Tzur Moshe/1565/04(H9N2) hemagglutinin | DQ108916.1 |
| A/turkey/Yedidia/625/02 (H9N2) hemagglutinin | DQ104463.1 |
| A/turkey/Yedidia/625/02 (H9N2) nucleoprotein | DQ116523.1 |
| A/turkey/Yedidia/625/02 (H9N2) neuraminidase | DQ116061.1 |
| A/turkey/Yedidia/911/02(H9N2) hemagglutinin | DQ104448.1 |
| A/turkey/Avigdor/1215/03(H9N2) hemagglutinin | DQ104454.1 |
| A/turkey/Avigdor/1209/03(H9N2) hemagglutinin | DQ104453.1 |
| A/turkey/Avichail/1075/02(H9N2) hemagglutinin | DQ104450.1 |
| A/turkey/Avigdor/1920/04(H9N2) hemagglutinin | DQ108926.1 |
| A/pintail/Alberta/49/2003(H9N5) matrix protein 1 (M) and matrix protein 2 (M) | DQ107498.1 |
| A/red knot/Delaware/2552/87 (H9N5) nonfunctional matrix protein | AY664472.1 |
| A/duck/Hong Kong/147/77(H9N6) hemagglutinin precursor | AY206671.1 |
| A/shorebird/Delaware/270/2001(H9N7) matrix protein 1 (M) and matrix protein 2 (M) | DQ107504.1 |
| A/shorebird/Delaware/277/2000(H9N7) matrix protein 1 (M) and matrix protein 2 (M) | DQ107507.1 |
| A/shorebird/Delaware/275/2001(H9N7)) matrix protein 2 (M) and matrix protein 1 (M) | DQ107506.1 |
| A/ruddy turnstone/Delaware/116/98 (H9N8) nonfunctional matrix protein | AY664435.1 |
| A/shorebird/Delaware/141/2002(H9N9) matrix protein 1 (M) and matrix protein 2 (M) | DQ107503.1 |
| A/ruddy turnstone/Delaware/103/2002(H9N9) matrix protein 1 (M) and matrix protein 2 (M) | DQ107502.1 |
| A/shorebird/Delaware/29/2002(H9N9) matrix protein 1 (M) and matrix protein 2 (M) | DQ107501.1 |
| A/shorebird/Delaware/18/2002(H9N9) matrix protein 1 (M) and matrix protein 2 (M) | DQ107500.1 |
| A/ruddy turnstone/Delaware/259/98 (H9N9) nonfunctional matrix protein | AY664469.1 |
| A/duck/Eastern China/527/2003(H10N3) segment 6 neuraminidase (NA) | EU429716.1 |
| A/duck/Eastern China/495/2003(H10N3) segment 6 neuraminidase (NA) | EU429715.1 |
| A/duck/Eastern China/372/2003(H10N3) segment 6 neuraminidase (NA) | EU429714.1 |
| A/duck/Eastern China/488/2003(H10N3) segment 6 neuraminidase (NA) | EU429712.1 |
| A/duck/Eastern China/453/2002(H10N3) segment 6 neuraminidase (NA) | EU429711.1 |
| A/duck/Eastern China/412/2003(H10N3) segment 6 neuraminidase (NA) | EU429710.1 |
| A/duck/Eastern China/404/2003(H10N3) segment 6 neuraminidase (NA) | EU429709.1 |
| A/duck/Eastern China/397/2003(H10N3) segment 6 neuraminidase (NA) | EU429708.1 |
| A/duck/Eastern China/502/2003(H10N3) segment 6 neuraminidase (NA) | EU429705.1 |
| A/duck/Eastern China/395/2003(H10N3) segment 6 neuraminidase (NA) | EU429704.1 |
| A/duck/Eastern China/356/2003(H10N3) segment 6 neuraminidase (NA) | EU429703.1 |
| A/duck/Eastern China/368/2003(H10N3) segment 6 neuraminidase (NA) | EU429702.1 |
| A/chicken/Singapore/1993(H10N5) M2 protein | EU014145.1 |
| A/red knot/Delaware/2561/87 (H10N5) nonfunctional matrix protein | AY664441.1 |
| A/chicken/Germany/N/1949(H10N7) segment 6 neuraminidase (NA) | EU429796.1 |
| A/ruddy turnstone/Delaware/2764/87 (H10N7) nonfunctional matrix protein | AY664462.1 |

TABLE 11-continued

| Other Influenza A Antigens (H4N*-H13N*) | |
|---|---|
| Strain/Protein | GenBank Access No. |
| A/mallard/Alberta/71/98 (H10N7) nonfunctional matrix protein | AY664485.1 |
| A/mallard/Alberta/90/97 (H10N7) nonfunctional matrix protein | AY664446.1 |
| A/mallard/Alberta/110/99(Hl0N7) nonfunctional matrix protein | AY664481.1 |
| A/mallard/Alberta/297/77 (H10N7) nonfunctional matrix protein | AY664430.1 |
| A/mallard/Alberta/223/98 (H10N8) nonfunctional matrix protein | AY664486.1 |
| A/ruddy turnstone/New Jersey/51/85 (H11N1) nonfunctional matrix protein | AY664479.1 |
| A/duck/Nanchang/1749/1992(H11N2) nucleoprotein (NP) | U49094.1 |
| A/duck/Hong Kong/62/1976(H11N2) polymerase (PB1) | U48280.1 |
| A/duck/Yangzhou/906/2002(H11N2) hemagglutinin | DQ080993.1 |
| A/shorebird/Delaware/86/99 (H11N2) nonfunctional matrix protein | AY664463.1 |
| A/ruddy turnstone/Delaware Bay/2762/1987(H11N2)polymerase PB2 (PB2) | CY126279.1 |
| A/ruddy turnstone/Delaware/2762/87 (H11N2) nonfunctional matrix protein | AY664459.1 |
| A/ruddy turnstone/Delaware Bay/2762/1987(H11N2) polymerase PB1 (PB1) and PB1-F2 protein (PB1-F2) | CY126278.1 |
| A/ruddy turnstone/Delaware/2589/87 (H11N4) nonfunctional matrix protein | AY664478.1 |
| A/duck/England/1/1956(H11N6) segment 6 neuraminidase (NA) | EU429795.1 |
| A/mallard/Alberta/125/99 (H11N6) nonfunctional matrix protein | AY664483.1 |
| A/duck/Memphis/546/1974(H11N9) segment 6 neuraminidase (NA) | EU429798.1 |
| A/mallard/Alberta/122/99 (H11N9) nonfunctional matrix protein | AY664444.1 |
| A/Mallard Duck/Alberta/342/83(H12N1) segment 4 hemagglutinin (HA1) | AF310991.1 |
| A/ruddy turnstone/Delaware/67/98(H12N4) nonfunctional matrix protein | AY664470.1 |
| A/Ruddy Turnstone/Delaware/67/98(H12N4) segment 4 hemagglutinin (HA1) | AF310990.1 |
| A/mallard/Alberta/52/97 (H12N5) nonfunctional matrix protein | AY664448.1 |
| A/mallard/Alberta/223/77 (H12N5) nonfunctional matrix protein | AY664431.1 |
| A/Laughing Gull/New Jersey/171/92(H12N5) segment 4 hemagglutinin (HA1) | AF310992.1 |
| A/ruddy turnstone/Delaware/265/98 (H12N8) nonfunctional matrix protein | AY664438.1 |
| A/herring gull/New Jersey/782/86 (H13N2) nonfunctional matrix protein | AY664475.1 |
| A/shorebird/Delaware/224/97 (H13N6) nonfunctional matrix protein | AY664421.1 |
| A/PR/8/34 (H1N1) × A/England/939/69 (H3N2) PB1 protein | AJ564806.1 |
| A/PR/8/34 (H1N1) × A/England/939/69 (H3N2)PB2 protein | AJ564804.1 |
| A/duck/Czechoslovakia/56(H4N6) × A/USSR/90/77(H1N1)) neuraminidase (NA) | EU643639.1 |
| A/duck/Czechoslovakia/56(H4N6) × A/USSR/90/77(H1N1)) neuraminidase (NA) | EU643638.1 |
| A/duck/Ukraine/63(H3N8) × A/USSR/90/77(H1N1)) neuraminidase (NA) | EU643637.1 |
| A/duck/Ukraine/63(H3N8) × A/USSR/90/77(H1N1)) neuraminidase (NA) | EU643636.1 |
| RCB1-XXI: A/USSR/90/77(H1N1) × A/Duck/Czechoslov 56 (H4N6) segment 4 hemagglutinin | AF290438.1 |
| RCB1: A/USSR/90/77(H1N1) × A/Duck/Czechoslov 56 (H4N6) hemagglutinin | AF290437.1 |
| PX14-XIII (A/USSR/90/77(H1N1) × A/Pintail Duck/Primorie/695/76(H2N3)) segment 4 hemagglutinin | AF290442.1 |
| PX14(A/USSR/90/77(H1N1) × A/Pintail Duck/Primorie/695/76(H2N3)) segment 4 hemagglutinin | AF290441.1 |
| PX8-XIII(A/USSR/90/77(H1N1) × A/Pintail Duck/Primorie/695/76(H2N3)) segment 4 hemagglutinin | |
| PX8(A/USSR/90/77(H1N1) × A/Pintail Duck/Primorie/695/76(H2N3)) segment 4 hemagglutinin | AF290439.1 |
| A/swine/Schleswig-Holstein/1/93 hemagglutinin (HA) | U72669.1 |
| A/swine/England/283902/93 hemagglutinin (HA) | U72668.1 |
| A/swine/England/195852/92 hemagglutinin (HA) | U72667.1 |
| A/swine/England/117316/86 hemagglutinin (HA) | U72666.1 |
| A/turkey/Germany/2482/90) hemagglutinin (HA) | U96766.1 |

TABLE 12

Influenza B Antigens

| Strain/Protein | GenBank Access No. |
|---|---|
| B/Daeku/47/97 hemagglutinin | AF521237.1 |
| B/Daeku/45/97 hemagglutinin | AF521236.1 |
| B/Daeku/10/97 hemagglutinin | AF521221.1 |
| B/Daeku/9/97 hemagglutinin | AF521220.1 |
| B/Gyeonggi/592/2005 neuraminidase | DQ231543.1 |
| B/Gyeonggi/592/2005 hemagglutinin | DQ231538.1 |
| B/Hong Kong/5/72 neuraminidase | AF305220.1 |
| B/Hong Kong/5/72 hemagglutinin | AF305219.1 |
| B/Hong Kong/157/99 hemagglutinin | AF387503.1 |
| B/Hong Kong/157/99 hemagglutinin | AF387502.1 |
| B/Hong Kong/156/99 hemagglutinin | AF387501.1 |
| B/Hong Kong/156/99 hemagglutinin | AF387500.1 |
| B/Hong Kong/147/99 hemagglutinin | AF387499.1 |
| B/Hong Kong/147/99 hemagglutinin | AF387498.1 |
| B/Hong Kong/110/99 hemagglutinin | AF387497.1 |
| B/Hong Kong/110/99 hemagglutinin | AF387496.1 |
| B/Incheon/297/2005 hemagglutinin | DQ231539.1 |
| B/Incheon/297/2005 neuraminidase | DQ231542.1 |
| B/Lee/40 polymerase protein (PB1) | D00004.1 |
| B/Michigan/22572/99 hemagglutinin | AY129961.1 |
| B/Michigan/22723/99 hemagglutinin (HA) | AY112992.1 |
| B/Michigan/22631/99 hemagglutinin (HA) | AY112991.1 |
| B/Michigan/22587/99 hemagglutinin (HA) | AY112990.1 |
| B/New York/20139/99 hemagglutinin | AY129960.1 |
| B/Panama/45/90 nucleoprotein | AF005739.1 |
| B/Panama/45/90 polymerase (PA) | AF005738.1 |
| B/Panama/45/90 polymerase (PB2) | AF005737.1 |
| B/Panama/45/90 polymerase (PB1) | AF005736.1 |
| B/Pusan/250/99 hemagglutinin | AF521218.1 |
| B/Pusan/255/99 hemagglutinin | AF521226.1 |
| B/Pusan/270/99 hemagglutinin | AF521219.1 |
| B/Pusan/285/99 hemagglutinin | AF521217.1 |
| B/Riyadh/01/2007 segment 8 nuclear export protein (NEP) and non structural protein 1 (NS1) | GU135839.1 |
| B/Seoul/6/88 hemagglutinin | AF521238.1 |
| B/Seoul/12/88 hemagglutinin | AF521239.1 |
| B/Seoul/1/89 hemagglutinin | AF521230.1 |
| B/Seoul/37/91 hemagglutinin | AF521229.1 |
| B/Seoul/38/91 hemagglutinin | AF521227.1 |
| B/Seoul/40/91 hemagglutinin | AF521235.1 |
| B/Seoul/41/91 hemagglutinin | AF521228.1 |
| B/Seoul/13/95 hemagglutinin | AF521225.1 |
| B/Seoul/12/95 hemagglutinin | AF521223.1 |
| B/Seoul/17/95 hemagglutinin | AF521222.1 |
| B/Seoul/21/95 hemagglutinin | AF521224.1 |
| B/Seoul/16/97 hemagglutinin | AF521233.1 |
| B/Seoul/19/97 hemagglutinin | AF521231.1 |
| B/Seoul/28/97 hemagglutinin | AF521234.1 |
| B/Seoul/31/97 hemagglutinin | AF521232.1 |
| B/Seoul/232/2004 neuraminidase | DQ231541.1 |
| B/Seoul/1163/2004 neuraminidase | DQ231540.1 |
| B/Seoul/1163/2004 hemagglutinin | DQ231537.1 |
| B/Sichuan/379/99 hemagglutinin (HA) | AF319590.1 |
| B/Sichuan/38/2000 hemagglutinin (HA) | AF319589.1 |
| B/South Carolina/25723/99 hemagglutinin | AY129962.1 |
| B/Switzerland/4291/97 hemagglutinin | AF387505.1 |
| B/Switzerland/4291/97 hemagglutinin | AF387504.1 |
| B/Taiwan/21706/97 nonstructural protein 1 (NS1) | AF492479.1 |
| B/Taiwan/21706/97 hemagglutinin (HA) | AF026162.1 |
| B/Taiwan/3143/97 nonstructural protein 1 (NS1) | AF492478.1 |
| B/Taiwan/3143/97 haemagglutinin (HA) | AF026161.1 |
| B/Taiwan/2026/99 nonstructural protein 1 (NS1) | AF492481.1 |
| B/Taiwan/2026/99 hemagglutinin | AY604741.1 |
| B/Taiwan/2027/99 nonstructural protein 1 (NS1) | AF492480.1 |
| B/Taiwan/2027/99 hemagglutinin | AY604742.1 |
| B/Taiwan/1243/99 nonstructural protein NS1(NS1) | AF380504.1 |
| B/Taiwan/1243/99 hemagglutinin | AY604740.1 |
| B/Taiwan/2195/99 hemagglutinin | AY604743.1 |
| B/Taiwan/2195/99 nonstructural protein 1 (NS1) | AF492482.1 |
| B/Taiwan/1293/2000 nonstructural protein NS1(NS1) | AF380509.1 |
| B/Taiwan/1293/00 hemagglutinin | AY604746.1 |
| B/Taiwan/1293/2000 hemagglutinin (HA) | AF492477.1 |
| B/Taiwan/1265/2000 nonstructural protein NS1 (NS1) | AF380508.1 |
| B/Taiwan/1265/00 hemagglutinin | AY604745.1 |
| B/Taiwan/4184/2000 nonstructural protein NS1 (NS1) | AF380507.1 |
| B/Taiwan/4184/00 hemagglutinin (HA) | AY604750.1 |
| B/Taiwan/31511/2000 nonstructural protein NS1 (NS1) | AF380505.1 |
| B/Taiwan/31511/00 hemagglutinin (HA) | AY604748.1 |
| B/Taiwan/12192/2000 hemagglutinin | AY604747.1 |
| B/Taiwan/41010/00 hemagglutinin (HA) | AY604749.1 |
| B/Taiwan/41010/2000 nonstructural protein NS1 (NS1) | AF380506.1 |
| B/Taiwan/0409/00 hemagglutinin (HA) | AY604744.1 |
| B/Taiwan/202/2001 nonstructural protein 1 (NS1) | AF380512.1 |
| B/Taiwan/202/2001 hemagglutinin (HA) | AF366076.1 |
| B/Taiwan/11515/2001 nonstructural protein 1 (NS1) | AF380511.1 |
| B/Taiwan/11515/01 hemagglutinin | AY604754.1 |
| B/Taiwan/11515/2001 hemagglutinin (HA) | AF366075.1 |
| B/Taiwan/1103/2001 nonstructural protein NS1 (NS1) | AF380510.1 |
| B/Taiwan/1103/01 hemagglutinin | AY604755.1 |
| B/Taiwan/114/2001 hemagglutinin (HA), HA-4 allele | AF492476.1 |
| B/Taiwan/2805/2001 hemagglutinin (HA) | AF400581.1 |
| B/Taiwan/2805/01 hemagglutinin (HA) | AY604752.1 |
| B/Taiwan/0114/01 hemagglutinin (HA) | AY604753.1 |
| B/Taiwan/0202/01 hemagglutinin (HA) | AY604751.1 |
| B/Taiwan/4119/02 hemagglutinin (HA) | AY604778.1 |
| B/Taiwan/4602/02 hemagglutinin (HA) | AY604777.1 |
| B/Taiwan/1950/02 hemagglutinin (HA) | AY604776.1 |
| B/Taiwan/1949/02 hemagglutinin (HA) | AY604775.1 |
| B/Taiwan/1584/02 hemagglutinin (HA) | AY604774.1 |
| B/Taiwan/1561/02 hemagglutinin (HA) | AY604773.1 |
| B/Taiwan/1536/02 hemagglutinin (HA) | AY604772.1 |
| B/Taiwan/1534/02 hemagglutinin (HA) | AY604771.1 |
| B/Taiwan/1503/02 hemagglutinin (HA) | AY604770.1 |
| B/Taiwan/1502/02 hemagglutinin (HA) | AY604769.1 |
| B/Taiwan/1013/02 hemagglutinin (HA) | AY604768.1 |
| B/Taiwan/0993/02 hemagglutinin (HA) | AY604766.1 |
| B/Taiwan/0932/02 hemagglutinin (HA) | AY604765.1 |
| B/Taiwan/0927/02 hemagglutinin (HA) | AY604764.1 |
| B/Taiwan/0880/02 hemagglutinin (HA) | AY604763.1 |
| B/Taiwan/0874/02 hemagglutinin (HA) | AY604762.1 |
| B/Taiwan/0730/02 hemagglutinin (HA) | AY604761.1 |
| B/Taiwan/0722/02 hemagglutinin (HA) | AY604760.1 |
| B/Taiwan/0702/02 hemagglutinin (HA) | AY604759.1 |
| B/Taiwan/0654/02 hemagglutinin (HA) | AY604758.1 |
| B/Taiwan/0600/02 hemagglutinin (HA) | AY604757.1 |
| B/Taiwan/0409/02 hemagglutinin (HA) | AY604756.1 |
| B/Taiwan/0879/02 nonfunctional hemagglutinin | AY604767.1 |
| B/Taiwan/3532/03 hemagglutinin (HA) | AY604794.1 |
| B/Taiwan/2551/03 hemagglutinin (HA) | AY604793.1 |
| B/Taiwan/1618/03 hemagglutinin (HA) | AY604792.1 |
| B/Taiwan/1574/03 hemagglutinin (HA) | AY604791.1 |
| B/Taiwan/1013/03 hemagglutinin (HA) | AY604790.1 |
| B/Taiwan/0833/03 hemagglutinin (HA) | AY604789.1 |
| B/Taiwan/0735/03 hemagglutinin (HA) | AY604788.1 |
| B/Taiwan/0699/03 hemagglutinin (HA) | AY604787.1 |
| B/Taiwan/0684/03 hemagglutinin (HA) | AY604786.1 |
| B/Taiwan/0616/03 hemagglutinin (HA) | AY604785.1 |
| B/Taiwan/0615/03 hemagglutinin (HA) | AY604784.1 |
| B/Taiwan/0610/03 hemagglutinin (HA) | AY604783.1 |
| B/Taiwan/0576/03 hemagglutinin (HA) | AY604782.1 |
| B/Taiwan/0569/03 hemagglutinin (HA) | AY604781.1 |
| B/Taiwan/0562/03 hemagglutinin (HA) | AY604780.1 |
| B/Taiwan/0002/03 hemagglutinin (HA) | AY604779.1 |
| B/Taiwan/773/2004 hemagglutinin (HA) | EU068195.1 |
| B/Taiwan/187/2004 hemagglutinin (HA) | EU068194.1 |
| B/Taiwan/3892/2004 hemagglutinin (HA) | EU068193.1 |
| B/Taiwan/562/2004 hemagglutinin (HA) | EU068191.1 |
| B/Taiwan/234/2004 hemagglutinin (HA) | EU068188.1 |
| B/Taiwan/4897/2004 hemagglutinin (HA) | EU068186.1 |
| B/Taiwan/8579/2004 hemagglutinin (HA) | EU068184.1 |
| B/Taiwan/184/2004 hemagglutinin (HA) | EU068183.1 |
| B/Taiwan/647/2005 hemagglutinin (HA) | EU068196.1 |
| B/Taiwan/877/2005 hemagglutinin (HA) | EU068198.1 |
| B/Taiwan/521/2005 hemagglutinin (HA) | EU068189.1 |
| B/Taiwan/1064/2005 hemagglutinin (HA) | EU068192.1 |
| B/Taiwan/3722/2005 hemagglutinin (HA) | EU068197.1 |
| B/Taiwan/5049/2005 hemagglutinin (HA) | EU068190.1 |
| B/Taiwan/5011/2005 hemagglutinin (HA) | EU068187.1 |
| B/Taiwan/4659/2005 hemagglutinin (HA) | EU068185.1 |
| B/Taiwan/25/2005 hemagglutinin (HA) | EU068182.1 |

TABLE 12-continued

Influenza B Antigens

| Strain/Protein | GenBank Access No. |
| --- | --- |
| B/Taiwan/1037/2005 hemagglutinin (HA) | EU068181.1 |
| B/Taiwan/62/2005 hemagglutinin (HA) | EU068180.1 |
| B/Taiwan/591/2005 hemagglutinin (HA) | EU068179.1 |
| B/Taiwan/649/2005 hemagglutinin (HA) | EU068178.1 |
| B/Taiwan/4554/2005 hemagglutinin (HA) | EU068177.1 |
| B/Taiwan/987/2005 hemagglutinin (HA) | EU068176.1 |
| B/Taiwan/2607/2006 hemagglutinin (HA) | EU068175.1 |
| B/Vienna/1/99 hemagglutinin | AF387495.1 |
| B/Vienna/1/99 hemagglutinin | AF387494.1 |
| B/Vienna/1/99 hemagglutinin | AF387493.1 |
| B/Vienna/1/99 hemagglutinin | AF387492.1 |

TABLE 13

Influenza C Antigens

| Strain/Protein | GenBank Access No. |
| --- | --- |
| C/JHB/1/66) hemagglutinin-esterase-fusion protein (HEF) mRNA, complete cds. | AY880247.1 |
| STRAIN C/ANN ARBOR/1/50) persistent variant segment 7 non-structural protein 1 (NS1) mRNA, complete cds | AF102027.1 |
| (STRAIN C/ANN ARBOR/1/50) wild type segment 7 non-structural protein 1 (NS1) mRNA, complete cds | AF102026.1 |
| (C/JHB/1/66) hemagglutinin-esterase-fusion protein (HEF) mRNA, complete cds | AY880247.1 |
| (STRAIN C/BERLIN/1/85) mRNA for basic polymerase 2 precursor | X55992.1 |

TABLE 14

H7 Hemagglutinin Amino Acid Sequences

| Accession No/ Strain/Protein | Amino Acid Sequence | SEQ ID NO: |
| --- | --- | --- |
| AAM19228 A/turkey/ Minnesota/ 38429/1988 1988// HA 20335017 | ACVLVEAKGDKICLGHHAVVNGTKVNTLTEKGIEVVNATETVETA NIGKICTQGKRPTDLGQCGLLGTLIGPPQCDQFLEFESDLIIERR EGNDVCYPGKFTNEESLRQILRGSGGIDKESMGFTYSGIITNGAT SACRRSGSSFYAEMKWLLSNSDNAAFPQMTKSYRNPRNKPALIVW GIHHSGSTTEQTKLYGSGNKLITVESSKYQQSFTPSPGARPQVNG ESGRIDFHWMLLDPNDTVTFTFNGAFIAPDRASFFKGESLGVQSD VPLDSSCGGDCFHSGGTIVSSLPFQNINPRTVGKCPRYVKQPSLL LATGMRNVPENPKTRGLFGAIAGFIEKDGGSHYG | 1 |
| AAY46211 A/mallard/ Sweden/91/2002 2002// HA 66394828 | MNTQILVFALVAIIPTNADKICLGHHAVSNGTKVNTLTERGVEVV NATETVERTNVPRICSRGKRTVDLGQCGLLGTITGPPQCDQFLEF SADLIIERREGSDVCYPGKFVNEEALRQILRESGGIDKETMGFTY SGIRTNGAPSACRRSGSSFYAEMKWLLSNTDNAAFPQMTKSYKNT RNDPALIIWGIHHSGSTTEQTKLYGSGNKLITVGSSNYQQSFVPS PGARPQVNGQSGRIDFHWLILNPNDTVTFSFNGAFIAPDRASFLR GKSMGIQSGVQIDANCEGDCYHSGGTIISNLPFQNINSRAVGKCP RYVKQESLLLATGMKNVPEIPKGRGLFGAIAGFIENGWEGLIDGW YGFRHQNAQGEGTAADYKSTQSAIDQITGKLNRLIEKTNQQFELI DNEFTEVEKQIGNVINWTRDSMTEVVWSYNAELLVAMENQHTIDLA DSEMNKLYERVRRQLRENAEEDGTGCFEIFHKCDDDCMASIRNNT YDHSKYREEAMQNRIQIDPVKLSSGYKDVILWFSFGASCFILLAI AMGLVFMCVKNGNMRCTICI | 2 |
| ABI84694 A/turkey/ Minnesota/ 1/1988 1988/07/13 HA 115278573 | MNTQILVFIACVLVEAKGDKICLGHHAVVNGTKVNTLTEKGIEVV NATETVETANIGKICTQGKRPTDLGQCGLLGTLIGPPQCDQFLEF ESDLIIERREGNDVCYPGKFTNEESLRQILRGSGGIDKESMGFTY SGIRTNGATSACRRSGSSFYAEMKWLLSNSDNAAFPQMTKSYRNP RNKPALIVWGIHHSGSTTEQTKLYGSGNKLITVGSSKYQQSFTPS PGARPQVNGQSGRIDFHWMLLDPNDTVTFTFNGAFIAPDRASFFK GESLGVQSDVPLDSSCGGDCFHSGGTIVSSLPFQNINPRTVGKCP RYVKQPSLLLATGMRNVPENPKTRGLFGAIAGFIENGWEGLIDGW YGFKHQNAQGEGTAADYKSTQSAIDQITGKLNRLIDKTNQQFELI DNEFSEIEQQIGNVINWTRDSMTEVVWSYNAELLVAMENQHTIDLA DSEMNKLYERVRRQLRENAEEDGTGCFEIFHKCDDQCMESIRNNT YDHAQYRAESLQNRIQIDPVKLSSGYKDIILWFSFGASCFLLLAI AMGLVFICIKNGNMRCTICI | 3 |
| ABS89409 A/blue-winged teal/Ohio/566/ 2006 2006// HA 155016324 | MNTQILALIACMLIGAKGDKICLGHHAVANGTKVNTLTERGIEVV NATETVETANIKKICTQGKRPTDLGQCGLLGTLIGPPQCDQFLEF DTDLIIERREGTDVCYPGKFTNEESLRQILRGSGGIDKESMGFTY SGIRTNGATSACRRSGSSFYAEMKWLLSNSDNAAFPQMTKSYRNP RNKPALIIWGVHHSGSATEQTKLYGSGNKLITVGSSKYQQSFTPS PGARPQVNGQSGRIDFHWLLLDPNDTVTFTFNGAFIAPDRASFER GESLGVQSDVPLDSGCEGDCFHSGGTIVSSLPFQNINPRTVGKCP RYVKQTSLLLATGMRNVPENPKTRGLFGAIAGFIENGWEGLIDGW YGFRHQNAQGEGTAADYKSTQSAIDQITGKLNRLIDKTNQQFELI DNEFSEIEQQIGNVINWTRDSMTEVVWSYNAELLVAMENQHTIDLA DSEMNKLYERVRKQLRENAEEDGTGCFEIFHKCDDQCMESIRNNT YDHTQYRTESLQNRIQIDPVRLSSGYKDIILWFSFGASCFLLLAI AMGLVFICIKNGNMRCTICI | 4 |
| ACD03594 A/ruddy | MNTQILAFIACMLVGVRGDKICLGHHAVANGTKVNTLTEKGIEVV NATETVESANIKKICTQGKRPTDLGQCGLLGTLIGPPQCDQFLEF | 5 |

TABLE 14-continued

H7 Hemagglutinin Amino Acid Sequences

| Accession No/<br>Strain/Protein | Amino Acid Sequence | SEQ<br>ID NO: |
|---|---|---|
| turnstone/DE/<br>1538/2000<br>2000// HA<br>187384848 | DSDLIIERREGTDVCYPGKFTNEESLRQILRGSGGIDKESMGFTY<br>SGIRTNGATSACRRLGSSFYAEMKWLLSNSDNAAFPQMTKSYRNP<br>RNKPALIIWGVHHSGSANEQTKLYGSGNKLITVGSSKYQQSFTPS<br>PGARPQVNGQSGRIDFHWLLLDPNDTVTFTFNGAFIAPDRASFER<br>GESLGIQSDVPLDSSCGGDCFHSGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELM<br>DNEFNEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRTESLQNRIQIDPVKLSSGYKDIILWFSFGASCFLLLAI<br>AMGLIFICIKNGNMRCTICI | |
| BAH22785<br>A/duck/Mongolia/<br>119/2008<br>2008// HA<br>223717820 | MNTQILVFALVAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIGKETMGFTY<br>SGIRTNGATSACRRSGSSFYAEMKWLLSNTDNAAFPQMTKSYKNT<br>RKDPALIIWGIHHSGSTTEQTKLYGSGNKLITVGSSNYQQSFVPS<br>PGARPQVNGQSGRIDFHWLMLNPNDTVTFSFNGAFIAPDRASFLR<br>GKSMGIQSGVQVDANCEGDCYHNGGTIISNLPFQNINSRTVGKCP<br>RYVKQESLLLATGMKNVPEIPKGRGLFGAIAGFIENGWEGLIDGW<br>YGFRHQNAQGEGTAADYKSTQSAIDQITGKLNRLIERTNQQFELI<br>DNEFTEVEKQIGNVINWTRDSMTEVWSYNAELLVAMENQHTIDLA<br>DSEMNKLYERVKRQLRENAEEDGTGCFEIFHKCDDDCMASIRNNT<br>YDHSKYREEAMQNRIQIDPVKLSNGYKDVILWFSFGASCFILLAI<br>AMGLVFICVKNGNMRCTICI | 6 |
| CAY39406<br>A/Anascrecca/<br>Spain/<br>1460/2008<br>2008/01/26 HA<br>254674376 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RKDPALIIWGIHHSGSTTEQTKLYGSGSKLITVGSSNYQQSFVPS<br>PGARPQVNGQSGRIDFHWLMLNPNDTVTFSFNGAFIAPDRASFLR<br>GKSMGIQSGVQVDANCEGDCYHSGGTIISNLPFQNINSRAVGKCP<br>RYVKQESLMLATGMKNVPEIPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSITEVWSYNAELLVAMENQHTIDLA<br>DSEMNKLYERVKRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 7 |
| ACX53683<br>A/goose/Czech<br>Republic/1848-<br>K9/2009<br>2009/02/04 HA<br>260907763 | MNIQILVFALVAIIPTNADKICLGHHAVSNGTKVNTLTERGVEVV<br>NATETVERTNVPRICSKGKRTVDLGQCGLLGTITGPPQCDQFLEF<br>SADLIIERRGGSDVCYPGKFVNEEALRQILRESGGIDKETMGFTY<br>SGIRTNGATSACRRSGSSFYAEMKWLLSNTDNAAFPQMTKSYKNT<br>RKDPALIIWGIHHSGSTTEQTKLYGSGSKLITVGSSNYQQSFVPS<br>PGARPQVNGQSGRIDFHWLMLNPNDTVTFSFNGAFIAPDRASFLK<br>GKSMGIQSGVQVDANCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVKRQLRENAEEDGTGCFEIFHKCDDDCMASIRNNT<br>YDHSKYREEAMQNRIQINPVKLSSGYKDVILWFSFGASCFILLAI<br>AMGLVFICVKNGNMRCTICI | 8 |
| ACZ48625<br>A/turkey/<br>Minnesota/<br>38429/1988<br>1988// HA<br>269826341 | MNTQILVFIACVLVEAKGDKICLGHHAVVNGTKVNTLTEKGIEVV<br>NATETVETANIGKICTQGKRPTDLGQCGLLGTLIGPPQCDQFLEF<br>ESDLIIERREGNDVCYPGKFTNEESLRQILRGSGGIDKESMGFTY<br>SGIRTNGATSACRRSGSSFYAEMKWLLSNSDNAAFPQMTKSYRNP<br>RNKPALIVWGIHHSGSTTEQTKLYGSGNKLITVGSSKYQQSFTPS<br>PGARPQVNGQSGRIDFHWMLLDPNDTVTFTFNGAFIAPDRASFFK<br>GESLGVQSDVPLDSSCGGDCFHSGGTIVSSLPFQNINPRTVGKCP<br>RYVKQPSLLLATGMRNVPENPKTRGLFGAIAGFIENGWEGLIDGW<br>YGFKHQNAQGEGTAADYKSTQSAIDQITGKLNRLIDKTNQQFEL | 9 |
| ADC29485<br>A/mallard/Spain/<br>08.00991.3/<br>2005 2005/11/<br>HA 284927336 | STQSAIDQITGKLNRLIEKTNQQFELIDNEFTEVEKQIGNVINWT<br>RDSMTEVWSYNAELLVAMENQHTIDLADSEMNKLYERVKRQLREN<br>AEEDGTGCFEIFHKCDDDCMASIRNNTYDHSKYREEAMQNRIQID<br>PVKLSSGYKDVILWFSFGASCFILL | 10 |
| ADK71137<br>A/blue-winged<br>teal/Guatemala/<br>CIP049-<br>01/2008 | MNTQILALIACMLIGAKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSSYAEMKWLLSNDNAAFPQMTKSYRNP<br>RNKPALIIWGVHHSGSATEQTKLYGSGNKLITVGSSKYQQSFTPS | 11 |

TABLE 14-continued

H7 Hemagglutinin Amino Acid Sequences

| Accession No/<br>Strain/Protein | Amino Acid Sequence | SEQ<br>ID NO: |
|---|---|---|
| 2008/02/07 HA<br>301333785 | PGIRPQVNGQSGRIDFHWLLLDPNDTVTFTFNGAFIAPDRASFLR<br>GKSLGIQSDVPLDSGCEGDCFHSGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQHFELI<br>DNEFSEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRTESLQNRIQIDPVKLSSGYKDIILWFSFGASCFLLLAI<br>AMGLVFICIKNGNMRCTICI | |
| ADK71148<br>A/blue-winged<br>teal/Guatemala/<br>CIP049-<br>02/2008<br>2008/03/05 HA<br>301333804 | MNTQILALIACMLIGAKGDKICLGHHAVANGTKVNTLTERGIEVV<br>NXTETVETANIKKICTHGKRPTDLGQCGLLGTLIGPPQCDRFLEF<br>DADLIIERREGTDVCYPGKFTNEESLRQILRGSGGIDKESMGFTY<br>SGIRTNGATSACRRSGSSFYAEMKWLLSNSDNAAFPQMTKSYRNP<br>RNKPALIIWGVHHSGSATEQTKLYGSGNKLITVGSSKYQQSFTPS<br>PGIRPQVNGQSGRIDFHWLLLDPNDTVTFTFNGAFIAPDRASFLR<br>GKSLGIQSDVPLDSGCEGDCFHSGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRTESLQNRIQIDPVKLSSGYKDIILWFSFGASCFLLLAI<br>AMGLVFICIKNGNMRCTICI | 12 |
| ADN34727<br>A/goose/Czech<br>Republic/1848-<br>T14/2009<br>2009/02/04 HA<br>307141869 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERRGGSDVCYPGKFVNEEALRQILRESGGIDKETMGFTY<br>SGIRTNGXTSACRRSGSSFYAEMKWLLSNTDNAAFPQMTKSYKNT<br>RKDPALIIWGIHHSGSTTEQTKLYGSGSKLITVGSSNYQQSFVPS<br>PGARPQVNGQSGRIDFHWLMLNPNDTVTFSFNGAFIAPDRASFLK<br>GKSMGIQSGVQVDANCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVKRQLRENAEEDGTGCFEIFHKCDDDCMASIRNNT<br>YDHSKYREEAMQNRIQINPVKLSSGYKDVILWFSFGASCFILLAI<br>AMGLVFICVKNGNMRCTICI | 13 |
| AEK84760<br>A/wild<br>bird/Korea/A14/<br>2011 2011/02/<br>HA 341610308 | PAFIAPDRASFLRGKSMGIQSGVQVDASCEGDCYHSGGTIISNLP<br>FQNINSRAVGKCPRYVKQESLMLATGMKNVPELPKGRGLFGAIAG<br>FIENGWEGLIDGWYGFRHQNAQGEGTAADYKSTQSAIDQITGKLN<br>RLIEKTNQQFELIDNEFTEVEKQIGNVINWTRDSMTEVWSYNAEL<br>LVAMENQHTIDLADSEMNKLYERVRRQLRENAEEDGTGCFEIFHK<br>CDDDCMASIRNNTYDHSKYREEAMQNRIQIDPVKLSSGYKDVILW<br>FSFGASCFILLAIAMGLVFICVKNGNMRCTICI | 14 |
| AEK84761<br>A/wild<br>bird/Korea/A3/<br>2011 2011/02/<br>HA 341610310 | ILVFALVAIIPTNANKIGLGHHAVSNGTKVNTLTERGVEVFNATE<br>TVERTNVPRICSKGKKTVDLGQCGLRGTITGPPQCDQFLKFSPDL<br>IIERRQKGSDVCYPGKFVNEKPLRQILRESGGIDKETMGFAYNGIK<br>TNGPPIACRKSGSSFYAKMKWLLSNTDKAAFPQMTKSYKNTRRNP<br>ALIVWGIHHSGSTTKQTKLYGIGSNLITVGSSNYQQSFVPSPGAR<br>PQVNGQSGRIDFHWLILNPNDTVTFSFNGAFIPPDRASFLRGKSM<br>GIQSGVQVDASCEGDCYHSGGTIISNLPFQNINSRAVGKCPRYVK<br>QESLMLATGMKNVPELPKGKGLFGAIAGFIENGWEGLIDGWYGFR<br>HQNAQGEGTAADYKSTQSAIDQITGKLNRLIEKTNQQFELIDNEF<br>TEVEKQIGNVINWTRDSMTEVWSYNAELLVAMENQHTIDLADSEM<br>NKLYERVRRQLRENAEEDGTGCFEIFHKCDDDCMASIRNNTYDHS<br>KYREEAMQNRIQIDPVKLSSGYKDVILWFSFGASCFILLAIAMGL<br>VFICVKNGNMRCTICI | 15 |
| AEK84763<br>A/wild<br>bird/Korea/A9/<br>2011 2011/02/<br>HA 341610314 | ILVFALVAIIPTNANKIGLGHHAVSNGTKVNTLTERGVEFFNATE<br>TVEPINVPRICSKGKKTVDLGQCGLLGTITGPPQCDQFLEFSADL<br>IIERREGSDVCYPGKFVNEKALRQILRESGGIDKETMGFAYSGIK<br>TNGPPIACRKSGSSFYAKMKWLLSNTDKAAFPQMTKSYKNTRRDP<br>ALIVWGIHHSGSTIKQINLYGIGSNLITVGSSNYQQSFVPSPGAR<br>PQVNGQSGRIDFHWLILNPNDTVIFIENGAFIAPDRASFLIGKSM<br>GIQSGVQVDASCEGDCYHSGGTIISNLPFQNINSRAVGKCPRYVK<br>QESLMLATGMKNVPELPKGRGLFGAIAGFIENGWEGLIDGWYGFR<br>HQNAQGEGTAADYKSTQSAIDQITGKLNRLIEKTNQQFELIDNEF<br>TEVEKQIGNVINWTRDSMTEVWSYNAELLVAMENQHTIDLADSEM<br>NKLYERVRRQLRENAEEDGTGCFEIFHKCDDDCMASIRNNTYDHS<br>KYREEAMQNRIQIDPVKLSSGYKDVILWFSFGASCFILLAIAMGL<br>VFICVKNGNMRCTICI | 16 |
| AEK84765<br>A/spot-billed | LVFALVAIIPTNADKICLGHHAVSNGTKVNTLTERGVEVVNATET<br>VERTNVPRICSKGKRTVDLGQCGLLGTITGPPQCDQFLEFSADLI | 17 |

TABLE 14-continued

H7 Hemagglutinin Amino Acid Sequences

| Accession No/<br>Strain/Protein | Amino Acid Sequence | SEQ<br>ID NO: |
|---|---|---|
| duck/Korea/447/<br>2011 2011/04/<br>HA 341610318 | IERREGSDVCYPGKFVNEEALRQILRESGGIDKETMGFTYSGIRT<br>NGATSACRRSGSSFYAEMKWLLSNTDNAAFPQMTKSYKNTRRDPA<br>LIVWGIHHSGSTTEQTKLYGSGSKLITVGSSNYQQSFVPSPGARP<br>QVNGQSGRIDFHWLILNPNDTVTFSFNGAFIAPDRASFLRGKSMG<br>IQSGVQVDASCEGDCYHSGGTIISNLPFQNINSRAVGKCPRYVKQ<br>ESLMLATGMKNVPEPPKGRGLFGAIAGFIENGWEGLIDGWYGFRH<br>QNAQGEGTAADYKSTQSAIDQITGKLNRLIEKTNQQFELIDNEFT<br>EVEKQIGNVINWTRDSMTEVWSYNAELLVAMENQHTIDLADSEMN<br>KLYERVRRQLRENAEEDGTGCFEIFHKCDDDCMARIRNNTYDHSK<br>YREEAMQNRIQIDPVKLSSGYKDVILWFSFGASCFILLAIAMGLV<br>FICVKNGNMRCTICI | |
| AEM98291<br>A/wild<br>duck/Mongolia/<br>1-241/2008<br>2008/04/ HA<br>344196120 | SILVFALVAIIPTNADKICLGHHAVSNGTKVNTLTERGVEVVNAT<br>ETVERTNVPRICSKGKRTVDLGQCGLLGTITGPPQCDQFLEFSAD<br>LIIERREGSDVCYPGKFVNEEALRQILRESGGIDKETMGFTYSGI<br>RTNGATSACRRSGSSFYAEMKWLLSNTDNAAFPQMTKSYKNTRKD<br>PALIIWGIHHSGSTTEQTKLYGSGSKLITVGSSNYQQSFVPSPGA<br>RPQVNGQSGRIDFHWLMLNPNDTVTFSFNGAFIAPDRASFLRGKS<br>MGIQSGVQVDANCEGDCYHSGGSIISNLPFQNINSRAVGKCPRYV<br>KQESLMLATGMKNVPELPKGRGLFGAIAGFIENGWEGLIDGWYGF<br>RHQNAQGEGTAADYKSTQSAIDQITGKLNRLIEKTNQQFELIDNE<br>FTEVEKQIGNVINWTRDSMTEVWSYNAELLVAMENQHTIDLADSE<br>MNKLYERVKRQLRENAEEDGTGCFEIFHKCDDDCMASIRNNTYDH<br>SKYREEAMQNRIQINPVKLSSGYKDVILWFSFGASCFILLAIAMG<br>LVFICVKNGNMRCTI | 18 |
| AFM09439<br>A/emperor<br>goose/Alaska/<br>44063-061/2006<br>2006/05/23 HA<br>390535062 | QILAFIACMLIGAKGDKICLGHHAVANGTKVNTLTERGIEVVNAT<br>ETVETVNIKKICTQGKRPTDLGQCGLLGTLIGPPQCDQFLEFDAD<br>LIIERRKGTDVCYPGKFTNEESLRQILRGSGGIDKESMGFTYSGI<br>RTNGATSACRRSGSSFYAEMKWLLSNSDNAAFPQMTKSYRNPRNK<br>PALIIWGVHHSGSATEQTKLYGSGNKLITVGSSKYQQSFVPSPGA<br>RPQVNGQSGRIDFHWLLLDPNDTVTFTFNGAFIAPERASFERGES<br>LGVQSDVPLDSGCEGDCFHSGGTIVSSLPFQNINPRTVGKCPRYV<br>KQTSLLLATGMRNVPENPKTRGLFGAIAGFIENGWEGLIDGWYGF<br>RHQNAQGEGTAADYKSTQSAIDQITGKLNRLIDKTNQQFELIDNE<br>FSEIEQQIGNVINWTRDSMTEVWSYNAELLVAMENQHTIDLADSE<br>MNKLYERVKRQLRENAEEDGTGCFEIFHKCDDQCMESIRNNTYDH<br>TQYRTESLQNRIQINPVKLSSGYKDIILWFSFGASCFLLLAIAMG<br>LVFICIKNGNMRCTICI | 19 |
| AFV33945<br>A/guinea<br>fowl/Nebraska/<br>17096-1/2011<br>2011/04/05 HA<br>409676820 | MNTQILALIACMLIGAKGDKICLGHHAVANGTKVNTLTERRIEVV<br>NATETVETANIKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSNNAAFPQMTKSYRNP<br>RNKPALIVWGVHHSGSATEQTKLYGSGSKLITVGSSKYQQSFTPS<br>PGARPQVNGQSGRIDFHWLLLDPNDTVTFTFNGAFIAPDRASFFR<br>GESLGVQSDVPLDSGCEGDCFHKGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEIWSYNAELLVAMENQHTIDLA<br>DSEMNKLYERVKQLRENAEEDGTGCFEIFHKCDDQCMESIRNNT<br>YDHTQYRAESLQNRIQIDPVKLSSGYKDIILWFSFGASCFLLLAI<br>AMGLVFICIKNGNMRCTICI | 20 |
| AFV33947<br>A/goose/<br>Nebraska/17097-<br>4/2011<br>2011/04/05 HA<br>409676827 | MNTQILALIACMLIGAKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSDNAAFPQMTKSYRNP<br>RNKPALIVWGVHHSASATEQTKLYGSGSKLITVGSSKYQQSFTPS<br>PGARPQVNGQSGRIDFHWLLLDPNDTVTFTFNGAFIAPDRASFFR<br>GESLGVQSDVPLDSGCEGDCFHKGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEIWSYNAELLVAMENQHTIDLA<br>DSEMNKLYERVKQLRENAEEDGTGCFEIFHKCDDQCMESIRNNT<br>YDHTQYRAESLQNRIQIDPVKLSSGYKDIILWFSFGASCFLLLAI<br>AMGLVFICIKNGNMRCTICI | 21 |
| AFX85260<br>A/ruddy<br>turnstone/<br>Delaware<br>Bay/220/1995<br>1995/05/21 HA<br>423514912 | MNTQILAFIACMLIGINGDKICLGHHAVANGTKVNTLTERGIEVV<br>NATETVETANIKRICTQGKRPIDLGQCGLLGTLIGPPQCDQFLEF<br>DSDLIIERREGTDVCYPGKFTNEESLRQILRGSGGIDKESMGFTY<br>SGIRTNGATSACIRLGSSFYAEMKWLLSNSDNAAFPQMTKSYRNP<br>RNKPALIIWGVHHSGSANEQTKLYGSGNKLITVGSSKYQQSFTPS<br>PGARPQVNGQSGRIDFHWLLLDPNDTVTFTFNGAFIAPDRASFFR<br>GESLGVQSDVPLDSSCGGDCFHSGGTIVSSLPFQNINPRTVGRCP | 22 |

TABLE 14-continued

H7 Hemagglutinin Amino Acid Sequences

| Accession No/<br>Strain/Protein | Amino Acid Sequence | SEQ ID NO: |
|---|---|---|
| | RYVKQTSLLLATGMKNVPENPKTRGLFGAIAGFIENGWEGLIDGW<br>YGFRHQNAQGEGTAADYKSTQSAIDQITGKLNRLIDKTNQQFELI<br>DNEFNEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRTESLQNRIQIDPVKLSSGYKDIILWFSFGASCFLLLAI<br>AMGLVFICIKNGNMRCTICI | |
| AGE08098<br>A/northern<br>shoverl/<br>Mississippi/<br>11OS145/2011<br>2011/01/08 HA<br>444344488 | MNTQILTLIACMLIGAKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSDNAAFPQMTKSYRNP<br>RNKPALIIWGVHHSGSATEQTKLYGSGNKLITVGSSKYQQSFTPS<br>PGARPQVNGQSGRIDFHWLLLDPNDTVTFTFNGAFIAPDRASFFR<br>GESLGVQSDVPLDSGCEGDCFHNGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRAESLQNRIQIDPVKLSSGYKDIILWFSFGASCFLLLAI<br>AMGLVFICIKNGNMRCTICI | 23 |
| AGI60301<br>A/Hangzhou/1/<br>2013 2013/03/24<br>HA 475662454 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGISGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 24 |
| AGI60292<br>A/Shanghai/<br>4664T/2013<br>2013/03/05 HA<br>476403560 | MNTQILVFALIAIIPANADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCHHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 25 |
| AGJ72861<br>A/chicken/<br>Zhejiang/DTID-<br>ZJU01/2013<br>2013/04/<br>HA 479280294 | MNTQILVFALIAIIPTNADKICLGHHAVSNGTKVNTLTERGGEVV<br>NATETVERTNIPRICSKGKGKKTVDLGQGGPRGTITGPPQCDQFLEF<br>SADLIMERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGQSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 26 |
| AGJ73503<br>A/Nanjing/1/<br>2013 2013/03/28<br>HA 479285761 | MNTQILVFALIAIIPTNADKICLGHHAVSNGTKVNTLTERGVEVV<br>NATETVERTNIPRICSKGKMTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA | 27 |

TABLE 14-continued

H7 Hemagglutinin Amino Acid Sequences

| Accession No/<br>Strain/Protein | Amino Acid Sequence | SEQ<br>ID NO: |
|---|---|---|
| | DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| BAN16711<br>A/duck/Gunma/<br>466/2011 2011//<br>HA 482661571 | MNIQVLVFALMAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGITSACRRSGSSFYAEMKWLLSNTDNAAFPQMTKSYKNT<br>RRDPALIAWGIHHSGSTTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDDTGCFEIFHKCDDDCMASIRNNT<br>YDHSKYREEAMQNRIQIDPVKLSSGYKDVILWFSFGASCFILLAI<br>AMGLVFICVKNGNMRCTICI | 28 |
| AGK84857<br>A/Hangzhou/2/<br>2013 2013/04/01<br>HA 485649824 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQIIKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 29 |
| AGL44438<br>A/Shanghai/02/<br>2013<br>2013/03/05 HA<br>496493389 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 30 |
| AGL33692<br>A/Shanghai/<br>4655T/2013<br>2013/02/26 HA<br>491874175 | GMIDGWYGFRHQNAQGEGTAADYKSTQSAIDQITGKLNRLIEKTN<br>QQFELIDNEFTEVEKQIGNVINWTRDSITEVWSYNAELLVAMENQ<br>HTIDLADSEMDKLYERVKRQLRENAEEDGTGCFEIFHKCDDDCMA<br>SIRNNTYDHSKYREEAMQNRIQIDPVKLSSGYKDVILWFSFGASC<br>FILLAIAMGLVFICVKNGNMRCTICI | 31 |
| AGL33693<br>A/Shanghai/<br>4659T/2013<br>2013/02/27 HA<br>491874186 | GMIDGWYGFRHQNAQGEGTAADYKSTQSAIDQITGKLNRLIEKTN<br>QQFELIDNEFNEVEKQIGNVINWTRDSITEVWSYNAELLVAMENQ<br>HTIDLADSEMDKLYERVKRQLRENAEEDGTGCFEIFHKCDDDCMA<br>SIRNNTYDHSKYREEAMQNRIQIDPVKLSSGYKDVILWFSFGASC<br>FILLAIVMGLVFICVKNGNMRCTICI | 32 |
| AGL95088<br>A/Taiwan/<br>S02076/2013<br>2013/04/22 HA<br>501485301 | VFALIAIIPTNADKICLGHHAVSNGTKVNTLTERGVEVVNATETV<br>ERTNIPRICSKGKRTVDLGQCGLLGTITGPPQCDQFLEFSADLII<br>ERREGSDVCYPGKFVNEEALRQILRESGGIDKEAMGFTYSGIRTN<br>GATSACRRSGSSFYAEMKWLLSNTDNAAFPQMTKSYKNTRKSPAL<br>IVWGIHHSVSTAEQTKLYGSGNKLVTVGSSNYQQSFVPSPGARPQ<br>VNGLSGRIDFHWLMLNPNDTVTFSFNGAFIAPDRASFLRGKSMGI<br>QSGVQVDANCEGDCYHSGGTIISNLPFQNIDSRAVGKCPRYVKQR<br>SLLLATGMKNVPEIPKGRGLFGAIAGFIENGWEGLIDGWYGFRHQ<br>NAQGEGTAADYKSTQSAIDQITGKLNRLIEKTNQQFELIDNEFNE<br>VEKQIGNVINWTRDSITEVWSYNAELLVAMENQHTIDLADSEMDK<br>LYERVKRQLRENAEEDGTGCFEIFHKCDDDCMASIRNNTYDHSKY<br>REEAMQNRIQIDPVKLSSGYKDVILWFSFGASCFILLAIVMGLVF<br>ICVKNGNMR | 33 |
| AGL95098<br>A/Taiwan/<br>T02081/2013 | LVFALIAIIPTNADKICLGHHAVSNGTKVNTLTERGVEVVNATET<br>VERTNIPRICSKGKRTVDLGQCGLLGTITGPPQCDQFLEFSADLI<br>IERREGSDVCYPGKFVNEEALRQILRESGGIDKEAMGFTYSGIRT | 34 |

TABLE 14-continued

H7 Hemagglutinin Amino Acid Sequences

| Accession No/<br>Strain/Protein | Amino Acid Sequence | SEQ<br>ID NO: |
|---|---|---|
| 2013/04/22 HA<br>501485319 | NGATSACRRSGSSFYAEMKWLLSNTDNAAFPQMTKSYKNTRKSPA<br>LIVWGIHHSVSTAEQTKLYGSGNKLVTVGSSNYQQSFVPSPGARP<br>QVNGLSGRIDFHWLMLNPNDTVTFSFNGAFIAPDRASFLRGKSMG<br>IQSGVQVDANCEGDCYHSGGTIISNLPFQNIDSRAVGKCPRYVKQ<br>RSLLLATGMKNVPEIPKGRGLFGAIAGFIENGWEGLIDGWYGFRH<br>QNAQGEGTAADYKSTQSAIDQITGKLNRLIEKTNQQFELIDNEFN<br>EVEKQIGNVINWTRDSITEVWSYNAELLVAMENQHTIDLADSEMD<br>KLYERVKRQLRENAEEDGTGCFEIFHKCDDDCMASIRNNTYDHSK<br>YREEAMQNRIQIDPVKLSSGYKDVILWFSFGASCFILLAIVMGLV<br>FICVKNGNMRCT | |
| AGM53883<br>A/Shanghai/<br>5083T/2013<br>2013/04/20 HA<br>507593986 | GFRHQNAQGEGTAADYKSTQSAIDQITGKLNRLIEKTNQQFELID<br>NEFNEVEKQIGNVINWTRDSITEVWSYNAELLVAMENQHTIDLAD<br>SEMDKLYERVKRQLRENAEEDGTGCFEIFHKCDDDCMASIRNNTY<br>DHSKYREEAMQNRIQIDPVKLSSGYKDVILWFSFGASCFILLAIV<br>MGLVFICVKNGNMRCT | 35 |
| AGM53884<br>A/Shanghai/<br>5180T/2013<br>2013/04/23 HA<br>507593988 | AQGEGTAADYKSTQSAIDQITGKLNRLIEKTNQQFELIDNEFNEV<br>EKQIGNVINWTRDSITEVWSYNAELLVAMENQHTIDLADSEMDKL<br>YERVKRQLRENAEEDGTGCFEIFHKCDDDCMASIRNNTYDHSKYR<br>EEAMQNRIQIDPVKLSSGYKDVILWFSFGASCFILLAIVMGLVFI<br>CVKNGNMRCTICI | 36 |
| AGM53885<br>A/Shanghai/<br>5240T/2013<br>2013/04/25 HA<br>507593990 | QNAQGEGTAADYKSTQSAIDQITGKLNRLIEKTNQQFELIDNEFN<br>EVEKQIGNVINWTRDSITEVWSYNAELLVAMENQHTIDLADSEMD<br>KLYERVKRQLRENAEEDGTGCFEIFHKCDDDCMASIRNNTYDHSK<br>YREEAMQNRIQIDPVKLSSGYKDVILWFSFGASCFILLAIVMGLV<br>FICVKNGNMRCT | 37 |
| AGM53886<br>A/Shanghai/<br>4842T/2013<br>2013/04/13 HA<br>507593992 | NAQGEGTAADYKSTQSAIDQITGKLNRLIEKTNQQFELIDNEFNE<br>VEKQIGNVINWTRDSITEVWSYNAELLVAMENQHTIDLADSEMDK<br>LYERVKRQLRENAEEDGTGCFEIFHKCDDDCMASIRNNTYDHSKY<br>REEAMQNRIQIDPVKLSSGYKDVILWFSFGASCFILLAIVMGLVF<br>ICVKNGNMRCT | 38 |
| AGM53887<br>A/Shanghai/<br>4701T/2013<br>2013/04/06 HA<br>507593994 | NAQGEGTAADYKSTQSAIDQITGKLNRLIEKTNQQFELIDNEFNE<br>VEKQIGNVINWTRDSITEVWSYNAELLVAMENQHTIDLADSEMDK<br>LYERVKRQLRENAEEDGTGCFEIFHKCDDDCMASIRNNTYDHSKY<br>REEAMQNRIQIDPVKLSSGYKDVILWFSFGASCFILLAIVMGLVF<br>ICVKNGNMRCTIC | 39 |
| AGN69462<br>A/Wuxi/2/2013<br>2013/03/31 HA<br>511105778 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGSTSACRRSGSSFYAEMKWLLSNTDNAAFPQMTKSYKNT<br>RKSPALIVWGIHHSVSTAEQTKLYGSGSKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 40 |
| AGN69474<br>A/Wuxi/1/2013<br>2013/03/31 HA<br>511105798 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLINGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 41 |
| AGO51387<br>A/Jiangsu/2/<br>2013 2013/04/20<br>HA 514390990 | MNTQILVFALIAIIPTNADKICLGHHAVSNGTKVNTLTERGVEVV<br>NATETVERTNIPRICSKGKMTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR | 42 |

TABLE 14-continued

H7 Hemagglutinin Amino Acid Sequences

| Accession No/<br>Strain/Protein | Amino Acid Sequence | SEQ<br>ID NO: |
|---|---|---|
| | GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYRKEAMKBXIQIDPVKLSSGYKDVXJWFSFGASCFILLAI<br>VMGLVFICVKNGNMRCTICI | |
| BAN59726<br>A/duck/Mongolia/<br>147/2008<br>2008/08/29 HA<br>519661951 | MNTQILVFALVAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIGKETMGFTY<br>SGIRTNGATSACRRSRSSFYAEMKWLLSNTDNAAFPQMIRSYKNT<br>RKDPALIIWGIHHSGSTTEQTKLYGSGNKLITVGSSNYQQSFVPS<br>PGARPQVNGQSGRIDFHWLMLNPNDTVTFSFNGAFIAPDRASFLR<br>GKSMGIQSGVQVDANCEGDCYHNGGTIISNLPFQNINSRTVGKCP<br>RYVKQESLLLATGMKNVPEIPKGRGLFGAIAGFIENGWEGLIDGW<br>YGFRHQNAQGEGTAADYKSTQSAIDQITGKLNRLIERTNQQFELI<br>DNEFTEVEKQIGNVINWTRDSMTEVWSYNAELLVAMENQHTIDLA<br>DSEMNKLYERVKRQLRENAEEDGTGCFEIFHKCDDDCMASIRNNT<br>YDHSKYREEAMQNRIQIDPVKLSNGYKDVILWFSFGASCFILLAI<br>AMGLVFICVKNGNMRCTICI | 43 |
| BAN59727<br>A/duck/Mongolia/<br>129/2010<br>2010// HA<br>519661954 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RKDPALIIWGIHHSGSTTEQTKLYGSGSKLITVGSSNYQQSFVPS<br>PGARPQVNGQSGRIDFHWLMLNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVKRQLRENAEEDGTGCFEIFHKCDDDCMASIRNNT<br>YDHSKYREEAMQNRIQINPVKLSSGYKDVILWFSFGASCFILLAI<br>AMGLVFICVKNGNMRCTICI | 44 |
| AGQ80952<br>A/duck/Jiangxi/<br>3096/2009<br>2009// HA<br>523788794 | MNTQILVFALVAIIPTNADKICLGHHAVSNGTKVNTLTERGVEVV<br>NATETVERTSIPRICSKGKRAVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQTIKSYKNT<br>RKDPALIIWGIHHSGSTTEQTKLYGSGNKLITVGSSNYQQSFVPS<br>PGARPQVNGQSGRIDFHWLMLNPNDTVTFSFNGAFIAPDRASFLR<br>GKSMGIQSGVQVDANCEGDCYHNGGTIISNLPFQNINSRAVGKCP<br>RYVKQESLLLATGMKNVPEIPKGRGLFGAIAGFIENGWEGLIDGW<br>YGFRHQNAQGEGTAADYKSTQSAIDQITGKLNRLIEKTNQQFELI<br>DNEFTEVERQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 45 |
| AGQ80989<br>A/duck/Jiangxi/<br>3257/2009<br>2009// HA<br>523788868 | MNTQILVFALVAIIPTNADKICLGHHAVSNGTKVNTLTERGVEVV<br>NATETVERTSIPRICSKGKRAVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQTIKSYKNT<br>RKDPALIIWGIHHSGSTTEQTKLYGSGNKLITVGXSNYQQSFVPS<br>PGARPQVNGQSGRIDFHWLMLNPNDTVTFSFNGAFIAPDRASFLR<br>GKSMGIQSGVQVDANCEGDCYHNGGTIISNLPFQNINSRAVGKCP<br>RYVKQESLLLATGMKNVPEIPKGRGLFGAIAGFIENGWEGLIDGW<br>YGFRHQNAQGEGTAADYKSTQSAIDQITGKLNRLIEKTNQQFELI<br>DNEFTEVERQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 46 |
| AGQ81043<br>A/chicken/<br>Rizhao/515/2013<br>2013// HA<br>523788976 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEEMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT | 47 |

TABLE 14-continued

H7 Hemagglutinin Amino Acid Sequences

| Accession No/<br>Strain/Protein | Amino Acid Sequence | SEQ<br>ID NO: |
|---|---|---|
| | YDHSKYREEAMQNRIQIDPVKLSSGYKDVILWFSFGASCFILLAI<br>VMGLVFICVKNGNMRCTICI | |
| AGR33894<br>A/chicken/<br>Rizhao/719b/2013<br>2013// HA<br>524845213 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDRSKYREEAMQNRXXXXXXXXXXXXXKDVILWFSFGASCFILLAI<br>VMGLVFICVKNGNMRCTICI | 48 |
| AGR49399<br>A/chicken/<br>Jiangxi/<br>SD001/2013<br>2013/05/03 HA<br>525338528 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 49 |
| AGR49495<br>A/chicken/<br>Shanghai/<br>S1358/2013<br>2013/04/03<br>HA 525338689 | MNTQILVFALIAIIPTNADKICLGHHAVSNGTKVNTLTERGVEVV<br>NATETVERTNIPRICSKGKMTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIKNNT<br>YDHSKYREEAMQNRIQIDPVKLSSGYKDVILWFSFGASCFILLAI<br>VMGLVFICVKNGNMRCTICI | 50 |
| AGR49506<br>A/chicken/<br>Shanghai/<br>S1410/2013<br>2013/04/03<br>HA 525338708 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGQSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 51 |
| AGR49554<br>A/chicken/<br>Zhejiang/<br>SD033/2013<br>2013/04/11<br>HA 525338789 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVRRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 52 |
| AGR49566<br>A/duck/Anhui/ | MNTQILVFALIAIIPTNADKICLGHHAVSNGTKVNTLTERGVEVV<br>NATETVERTNIPRICSKGKRTVDLGQCGLLGTITGPPQCDQFLEF | 53 |

TABLE 14-continued

H7 Hemagglutinin Amino Acid Sequences

| Accession No/<br>Strain/Protein | Amino Acid Sequence | SEQ<br>ID NO: |
|---|---|---|
| SC702/2013<br>2013/04/16 HA<br>525338809 | SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDNRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AGR49722<br>A/homing<br>pigeon/Jiangsu/<br>SD184/2013<br>2013/04/20 HA<br>525339071 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SEIRINGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGQSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 54 |
| AGR49734<br>A/pigeon/<br>Shanghai/<br>S1069/2013<br>2013/04/02 HA<br>525339091 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTITFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 55 |
| AGR49770<br>A/wild<br>pigeon/Jiangsu/<br>SD001/2013<br>2013/04/17 HA<br>525339151 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGQSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 56 |
| AGY41893<br>A/Huizhou/01/<br>2013 2013/08/08<br>HA 552049496 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 57 |
| AGY42258<br>A/mallard/<br>Sweden/91/2002<br>2002/12/12 HA<br>552052155 | FALVAIIPTNADKICLGHHAVSNGTKVNTLTERGVEVVNATETVE<br>RTNVPRICSRGKRTVDLGQCGLLGTIXGPPQCDQFLEFSADLIIE<br>RREGSDVCYPGKFVNEEALRQILRESGGIDKETMGFTYSGIRTNG<br>AXSACRRSGSSFYAEMKWLLSNTDNAAFPQMTKSYKNTRNDPALI<br>IWGIHHSGSTTEQTKLYGSGNKLITVGSSNYQQSFVPSPGARPQV<br>NGQSGRIDFHWLILNPNDTVTFSFNGAFIAPDRASFLRGKSMGIQ<br>SGVQIDANCEGDCYHSGGTIISNLPFQNINSRAVGKCPRYVKQES | 58 |

TABLE 14-continued

H7 Hemagglutinin Amino Acid Sequences

| Accession No/<br>Strain/Protein | Amino Acid Sequence | SEQ<br>ID NO: |
|---|---|---|
| | LLLATGMKNVPEIPKGRGLFGAIAGFIENGWEGLIDGWYGFRHQN<br>AQGEGTAADYKSTQSAIDQITGKLNRLIEKTNQQFELIDNEFTEV<br>EKQIGNVINWTRDSMTEVWSYNAELLVAMENQHTIDLADSEMNKL<br>YERVRRQLRENAEEDGTGCFEIFHKCDDDCMASIRNNTYDHSKYR<br>EEAMQNRIQIDPVKLSSGYKDVILWFSFGASCFILLAIAMGLVFM<br>CVKNGNMRCTICI | |
| AHA11441<br>A/guinea<br>fowl/Nebraska/<br>17096/2011<br>2011/04/10 HA<br>557478572 | MNTQILALIACMLIGAKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSNNAAFPQMTKSYRNP<br>RNKPALIVWGVHHSGSATEQKLYGSGSKLITVGSSKYQQSFTPS<br>PGARPQVNGQSGRIDFHWLLLDPNDTVTFTFNGAFIAPDRASFER<br>GESLGVQSDVPLDSGCEGDCFHKGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEIWSYNAELLVAMENQHTIDLA<br>DSEMNKLYERVRKQLRENAEEDGTGCFEIFHKCDDQCMESIRNNT<br>YDHIQYRAESLQNRIQIDPVKLSSGYKDIILWFSFGASCFLLLAI<br>AMGLVFICIKNGNMRCTICI | 59 |
| AHA11452<br>A/turkey/<br>Minnesota/<br>32710/2011<br>2011/07/12<br>HA 557478591 | MNTQILALIACMLVGIKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEEPLRQILRGSGGIDKESMGFTY<br>SGIRTNGATSTCRRSGSSFYAEMKWLLSNSNNAAFPQMTKSYRNP<br>RNKPALIVWGVHHSGSATEQTKLYGSGSKLITVGSSKYQQSFTPS<br>PGARPQVNGQSGRIDFHWLLLDPNDTVTFTFNGAFIAPDRASFER<br>GESLGVQSDVPLDSGCEGDCFHKGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFEMI<br>DNEFSEIEQQIGNVINWTRDSMTEIWSYNAELLVAMENQHTIDLA<br>DSEMNKLYERVRKQLRENAEEDGTGCFEIFHKCDDQCMESIRNNT<br>YDHIQYRAESLQNRIQIDPVKLSSGYKDIILWFSFGASCFLLLAI<br>AMGLVFICIKNGNMRCTICI | 60 |
| AHA11461<br>A/turkey/<br>Minnesota/<br>31900/2011<br>2011/07/05<br>HA 557478606 | MNTQILALIACMLVGIKGDKICLGHHAVANGTKVNTLTERGIEVV<br>NATETVETANIKKICTQGKRPTDLGQCGLLGTLIGPPQCDQFLEF<br>DADLIIERREGTDVCYPGKFTNEEPLRQILRGSGGIDKESMGFTY<br>SGIRTNGATSTCRRSGSSFYAEMKWLLSNSNNAAFPQMTKSYRNP<br>RNKPALIVWGVHHSGSATEQTKLYGSGSKLITVGSSKYQQSFTPS<br>PGARPQVNGQSGRIDFHWLLLDPNDTVTFTFNGAFIAPDRASFER<br>GESLGVQSDVPLDSGCEGDCFHKGGTIVSSLPFQNINPRTVGKCP<br>RYVKQTSLLLATGMRNVPENPKTRGLFGAIAGFIENGWEGLIDGW<br>YGFRHQNAQGEGTAADYKSTQSAIDQITGKLNRLIDKTNQQFELI<br>DNEFSEIEQQIGNVINWTRDSMTEIWSYNAELLVAMENQHTIDLA<br>DSEMNKLYERVRKQLRENAEEDGTGCFEIFHKCDDQCMESIRNNT<br>YDHIQYRAESLQNRIQIDPVKLSSGYKDIILWFSFGASCFLLLAI<br>AMGLVFICIKNGNMRCTICI | 61 |
| AHK10585<br>A/chicken/<br>Guangdong/<br>G1/2013<br>2013/05/05 HA<br>587680636 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 62 |
| AGG53366<br>A/wild<br>duck/Korea/<br>CSM42-34/2011<br>2011/03/<br>HA 459252887 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGLTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI | 63 |

TABLE 14-continued

H7 Hemagglutinin Amino Acid Sequences

| Accession No/<br>Strain/Protein | Amino Acid Sequence | SEQ<br>ID NO: |
|---|---|---|
| | DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVRLSSGYKDVILWFSFGASCFILLAI<br>AMGLVFICVKNGNMRCTICI | |
| AGG53377<br>A/wild<br>duck/Korea/<br>CSM42-1/2011<br>2011/03/<br>HA 459252925 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGLTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVRLSSGYKDVILWFSFGASCFILLAI<br>AMGLVFICVKNGNMRCT | 64 |
| AGG53399<br>A/wild<br>duck/Korea/<br>MHC39-26/2011<br>2011/03/<br>HA 459253005 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPEPPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 65 |
| AGG53432<br>A/wild<br>duck/Korea/<br>MHC35-41/2011<br>2011/03/<br>HA 459253136 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPEPPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCT | 66 |
| AGG53476<br>A/wild<br>duck/Korea/<br>SH19-27/2010<br>2010/12/<br>HA 459253257 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTI | 67 |
| AGG53487<br>A/wild<br>duck/Korea/<br>SH19-50/2010<br>2010/01/<br>HA 459253278 | MNTQILVFALVAIIPTNADKICLGHHAVSNGTKVNTLTERGVEVV<br>NATETVERTNVPRICSKGKRTVDLGQCGLLGTITGPPQCDQFLEF<br>SADLIIERREGSDVCYPGKFVNEEALRQILRESGGIDKETMGFTY<br>SGIRTNGATSACRRSGSSFYAEMKWLLSNTDNAAFPQMTKSYKNT<br>RRDPALIVWGIHHSGSSTEQTKLYGSGSKLITVGSSNYQQSFVPS<br>PGARPQVNGQSGRIDFHWLILNPNDTVTFSFNGAFIAPDRASFLR<br>GKSMGIQSGVQVDASCEGDCYHSGGTIISNLPFQNINSRAVGKCP<br>RYVKQESLMLATGMKNVPELPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSMTEVWSYNAELLVAMENQHTIDLA<br>DSEMNKLYERVRRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 68 |

TABLE 14-continued

H7 Hemagglutinin Amino Acid Sequences

| Accession No/<br>Strain/Protein | Amino Acid Sequence | SEQ ID NO: |
|---|---|---|
| AGG53520<br>A/wild<br>duck/Korea/<br>SH20-27/2008<br>2008/12/<br>HA 459253409 | QILVFALVAIIPTNADKICLGHHAVSNGTKVNTLTERGVEVVNAT<br>ETVERTNVPRICSKGKRTVDLGQCGLLGTITGPPQCDQLLEFSAD<br>LIIERREGTDVCYPGKFVNEEALRQILRESGGIEKETMGFTYSGI<br>RTNGATSACRRSGSSFYAEMKWLLSNTDNAAFPQMTKSYKNTRKD<br>PALIIWGIHHSGSTTEQTKLYGSGSKLITVGSSNYQQSFVPSPGA<br>RPQVNGQSGRIDFHWLMLNPNDTVTFSFNGAFIAPDRASFLRGKS<br>MGIQSGVQVDANCEGDCYHSGGTIISNLPFQNINSRAVGKCPRYV<br>KQESLMLATGMKNVPELPKGRGLFGAIAGFIENGWEGLIDGWYGF<br>RHQNAQGEGTAADYKSTQSAIDQITGKLNRLIEKTNQQFELIDNE<br>FTEVEKQIGNVINWTRDSMTEVWSYNAELLVAMENQHTIDLADSE<br>MNKLYERVKRQLRENAEEDGTGCFEIFHKCDDDCMASIRNNTYDH<br>SKYREEAMQNRIQINPVKLSSGYKDVILWFSFGASCFILLAIAMG<br>LVFICVKNGNMR | 69 |
| AGL43637<br>A/Taiwan/1/<br>2013 2013// HA<br>496297389 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGPSGRIDFHWLMLNPNDTVTFSFNGAFIAPDRASFLR<br>GKSMGIQSGVQVDANCEGDCYHSGGTIINNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 70 |
| AGL97639<br>A/mallard/<br>Minnesota/AI09-<br>3770/2009<br>2009/09/12 HA<br>505555371 | IACMLVGAKGDKICLGHHAVANGTKVNTLTERGIEVVNATETVET<br>ANIKKLCTQGKRPTDLGQCGLLGTLIGPPQCDQFLEFDADLIIER<br>REGTDVCYPGKFTNEESLRQIRGSGGIDKESMGFTYSGIRTNGA<br>TSACRRSGSSFYAEMKWLLSNSDNAAFPQMTKSYRNPRNKPALII<br>WGVHHSSATEQTKLYGSGNKLITVGSSKYQQSFTPSPGARPQVN<br>GQSGRIDFHWLLLDPNDTVTFTFNGAFIAPDRASFERGESLGVQS<br>DVPLDSGCEGDCFHSGGTIVSSLPFQNINPRTVGKCPRYVKQTSL<br>LLATGMRNVPENPKTRGLFGAIAGFIENGWEGLIDGWYGFRHQNA<br>QGEGTAADYKSTQSAIDQITGKLNRLIDKTNQQFELIDNEFSEIE<br>QQIGNVINWTRDSMTELWSYNAELLVAMENQHTIDLADSEMNKLY<br>ERVRKQLRENAEEDGIGCFEIFHKCDDQCMESIRNNTYDHIQYRT<br>ESLQNRIQIDPVKLS | 71 |
| AGO02477<br>A/Xuzhou/1/<br>2013 2013/04/25<br>HA 512403688 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGSKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKSRNMRCTICI | 72 |
| AGR84942<br>A/Suzhou/5/<br>2013 2013/04/12<br>HA 526304561 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGSKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 73 |
| AGR84954<br>A/Nanjing/6/<br>2013 2013/04/11<br>HA 526304594 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR | 74 |

TABLE 14-continued

H7 Hemagglutinin Amino Acid Sequences

| Accession No/<br>Strain/Protein | Amino Acid Sequence | SEQ<br>ID NO: |
|---|---|---|
| | GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNRNMRCTICI | |
| AGR84978<br>A/Wuxi/4/2013<br>2013/04/07 HA<br>526304656 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKSRNMRCTICI | 75 |
| AGR84990<br>A/Wuxi/3/2013<br>2013/04/07 HA<br>526304688 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKSRNMRCTICI | 76 |
| AGR85002<br>A/Zhenjiang/1/<br>2013<br>2013/04/07 HA<br>526304708 | MNTQILVFALIAIIPTNADKICLGHHAVSNGTKVNTLTERGVEVV<br>NATETVERTNIPRICSKGKMTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKSRNKRCTICI | 77 |
| AGR85026<br>A/Nanjing/2/<br>2013 2013/04/05<br>HA 526304762 | MNTQILVFALIAIIPTNADKICLGHHAVSNGTKVNTLTERGVEVV<br>NATETVERTNIPRICSKGKMTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKSRNMRCTICI | 78 |
| AGU02230<br>A/Zhejiang/<br>DTID-ZJU05/2013<br>2013/04/<br>HA 532808765 | LVFALIAIIPTNADKICLGHHAVSNGTKVNTLTERGGEVVNATET<br>VERTNIPRICSKGKRTVDLGQCGLRGTITGPPQCDQFLEFSADLI<br>IERREGSDVCYPGKFVNEEALRQILRESGGIDKEAMGFTYSGIRT<br>NGATSACRRSGSSFYAEMKWLLSNTDNAAFPQMTKSYKNTRKSPA<br>LIVWGIHHSVSTAEQTKLYGSGNKLVTVGSSNYQQSFVPSPGARP<br>QVNGLSGRIDFHWLMLNPNDTVTFSFNGAFIAPDRASFLRGKSMG<br>IQSGVQVDANCEGDCYHSGGTIISNLPFQNIDSRAVGKCPRYVKQ<br>RSLLLATGMKNVPEIPKGRGLFGAIAGFIENGWEGLIDGWYGFRH<br>QNAQGEGTAADYKSTQSAIDQITGKLNRLIEKTNQQFELIDNEFN<br>EVEKQIGNVINWTRDSITEVWSYNAELLVAMENQHTIDLADSEMD<br>KLYERVKRQLRENAEEDGTGCFEIFHKCDDDCMASIRNNTYDHSK | 79 |

TABLE 14-continued

H7 Hemagglutinin Amino Acid Sequences

| Accession No/<br>Strain/Protein | Amino Acid Sequence | SEQ<br>ID NO: |
|---|---|---|
| | YREEAMQNRIQIDPVKLSSGYKDVILWFSFGASCFILLAIVMGLV<br>FICVKNGNMRCT | |
| AGU02233<br>A/Zhejiang/<br>DTID-ZJU08/2013<br>2013/04/<br>HA 532808788 | FALIAIIPTNADKICLGHHAVSNGTKVNTLTERGGEVVNATETVE<br>RINFPRICSKGKRTVDLGQCGLRGTITGPPCDQFLEFSADLIIE<br>RREGSDVCYPGKFVNEEALRQILRESGGIDKEAMGFTYSGIRTNG<br>ATSACRRSGSSFYAEMKWLLSNTDNAAFPQMTKSYKNIRKSPALI<br>VWGIHHSVSTAEQTKLYGSGNKLVTVGSSNYQQSFVPSPGARPQV<br>NGLSGRIDFHWLMLNPNDTVTFSFNGAFIAPDRASFLRGKSMGIQ<br>SGVQVDANCEGDCYHSGGTIISNLPFQNIDSRAVGKCPRYVKQRS<br>LLLATGMKNVPEIPKGRGLFGAIAGFIENGWEGLIDGWYGFRHQN<br>AQGEGTAADYKSTQSAIDQITGKLNRLIEKTNQQFELIDNEFNEV<br>EKQIGNVINWTRDSITEVWSYNAELLVAMENQHTIDLADSEMDKL<br>YERVKRQLRENAEEDGTGCFEIFHKCDDDCMASIRNNTYDHSKYR<br>EEAMQNRIQIDPVKLSSGYKDVILWFSFGASCFILLAIVMGLVFI<br>CVKNGNMRCT | 80 |
| AGW82588<br>A/tree<br>sparrow/<br>Shanghai/01/2013<br>2013/05/09 HA<br>546235348 | MNTQILVFALIAIIPTNADKICLGHHAVSNGTKVNTLTERGVEVV<br>NATETVERTNIPRICSKGKRTVDLGQCGLLGTITGPPCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTIGI | 81 |
| AGW82600<br>A/Shanghai/<br>CN01/2013<br>2013/04/11 HA<br>546235368 | ALIAIIPTNADKICLGHHAVSNGTKVNTLTERGVEVVNATETVER<br>TNIPRICSKGKRTVDLGQCGLLGTITGPPCDQFLEFSADLIIER<br>REGSDVCYPGKFVNEEALRQILRESGGIDKEAMGFTYSGIRTNGA<br>TSACRRSRSSFYAEMKWLLSNTDNAAFPQMTKSYKNIRKSPALIV<br>WGIHHSVSTAEQTKLYGSGNKLVTVGSSNYQQSFVPSPGARPQVN<br>GLSGRIDFHWLMLNPNDTVTFSFNGAFIAPDRASFLRGKSMGIQS<br>GVQVDANCEGDCYHSGGTIMSNLPFQNIDSRAVGKCPRYVKQRSL<br>LLATGMKNVPEIPKGRGLFGAIAGFIENGWEGLIDGWYGFRHQNA<br>QGEGTAADYKSTQSAIDQITGKLNRLIEKTNQQFELIDNEFNEVE<br>KQIGNVINWTRDSITEVWSYNAELLVAMENQHTIDLADSEMDKLY<br>ERVKRQLRENAEEDGTGCFEIFHKCDDDCMASIRNNTYDHSKYRE<br>EAMQNRIQIDPVKLSSGYKDVILWFSFGASCFILLAIVMGLVFIC<br>VKNGNMRCTICI | 82 |
| AGW82612<br>A/Shanghai/<br>JS01/2013<br>2013/04/03 HA<br>546235388 | MNTQILVFALIAIIPTNADKICLGHHAVSNGTKVNTLTERGVEVV<br>NATETVERTNIPRICSKGKRTVDLGQCGLLGTITGPPCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKNPALIVWGIHHSGSTAEQTKLYGSGNKLVTVGSSNYQQSFAPS<br>PGARTQVNGQSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFTEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>AMGLVFICVKNGNMRCTICI | 83 |
| AHA11472<br>A/turkey/<br>Minnesota/<br>31676/2009<br>2009/12/08<br>HA 557478625 | MNTQILALIACMLIGAKGDKICLGHHAVANGTKVNTLTERGIEVV<br>NATETVETANVKKICTQGKRPTDLGQCGLLGTLIGPPCDQFLEF<br>DADLIIERREGTDVCYPGKFTNEESLRQILRGSSGIDKESMGFTY<br>SGIRTNGETSACRRSGSSFYAEMKWLLSNSNNAAFPQMTKSYRNP<br>RDKPALIIWGVHHSGSATEQTKLYGSGNKLITVGSSKYQQSFTPS<br>PGARPQVNGQSGRIDFHWLLLDPNDTVTFTFNGAFIAPDRASFFR<br>GESLGVQSDVPLDSGCEGDCFHSGGTIVSSLPFQNINPRTVGKCP<br>RYVKQTSLLLATGMRNVPEKPKTRGLFGAIAGFIENGWEGLIDGW<br>YGFRHQNAQGEGTAADYKSTQSAIDQITNKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHKCDDQCMESIRNNT<br>YDHTQYRKESLQNRIQIDPVKLSSGYKDIILWFSFGASCFLLLAI<br>AMGLVFICIKNGNMRCTICI | 84 |
| AHA11483<br>A/turkey/ | MNTQILALIACMLIGAKGDKICLGHHAVANGTKVNTLTERGIEVV<br>NATETVETANVKKICTQGKRPTDLGQCGLLGTLIGPPCDQFLEF | 85 |

TABLE 14-continued

H7 Hemagglutinin Amino Acid Sequences

| Accession No/<br>Strain/Protein | Amino Acid Sequence | SEQ<br>ID NO: |
|---|---|---|
| Minnesota/<br>14135-2/2009<br>2009/08/07 HA<br>557478644 | DADLIIERREGTDVCYPGKFTNEESLRQILRGSGGIDKESMGFTY<br>SGIRTNGATSACRRSGSSFYAEMKWLLSNSNNAAFPQMTKSYRNP<br>RDKPALIIWGVHHSGSATEQTKLYGSGNKLITVGSSKYQQSFTPS<br>PGARPQVNGQSGRIDFHWLLLDPNDTVTFTFNGAFIAPDRASFFR<br>GESLGVQSDVPLDSGCEGDCFHSGGTIVSSLPFQNINPRTVGKCP<br>RYVKQTSLLLATGMRNVPEKPKTRGLFGAIAGFIENGWEGLIDGW<br>YGFRHQNAQGEGTAADYKSTQSAIDQITSKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHKCDDDQCMESIRNNT<br>YDHTQYRKESLQNRIQIDPVKLSSGYKDIILWFSFGASCFLLLAI<br>AMGLVFICIKNGNMRCTICI | |
| AHA11500<br>A/Zhejiang/<br>DTID-ZJU10/2013<br>2013/10/14 HA<br>557478676 | TQILVFALIAIIPTNADKICLGHHAVSNGTKVNTLTERGVEVVNA<br>TETVERTNIPRICSKGKRTVDLGQCGLLGTITGPPQCDQFLEFSA<br>DLIIERREGSDVCYPGKFVNEEALRQILRESGGIDKEAMGFTYSG<br>IRINGATSACRRSGSSFYAEMKWLLSNTDNAAFPQMTKSYKNIRK<br>SPALIVWGIHHSVSTAEQTKLYGSGNKLVTVGSSNYQQSFVPSPG<br>ARPPVNGLSGRIDFHWLMLNPNDTVTFSFNGAFIAPDRASFLRGK<br>SMGIQSGVQVDANCEGDCYHSGGTIISNLPFQNIDSRAVGKCPRY<br>VKQRSLLLATGMKNVPEIPKGRGLFGAIAGFIENGWEGLIDGWYG<br>FRHQNAQGEGTAADYKSTQSAIDQITGKLNRLIEKTNQQFELIDN<br>EFNEVEKQIGNVINWTRDSITEVWSYNAELLVAMENQHTIDLADS<br>EMDKLYERVKRQLRENAEEDGTGCFEIFHKCDDDCMASIRNNTYD<br>HSKYREEAMQNRIQIDPVKLSSGYKDVILWFSFGASCFILLAIVM<br>GLVFICVKN | 86 |
| AHA57050<br>A/turkey/<br>Minnesota/<br>14659/2009<br>2009/08/12<br>HA 558484427 | MNTQILALIACMLIGAKGDKICLGHHAVANGTKVNTLTERGIEVV<br>NATETVETANVKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSNNAAFPQMTKSYRNP<br>RDKPALIIWGVHHSGSATEQTKLYGSGNKLITVGSSKYQQSFTPS<br>PGARPQVNGQSGRIDFHWLLLDPNDTVTFTFNGAFIAPDRASFFR<br>GESLGVQSDVPLDSGCEGDCFHSGGTIVSSLPFQNINPRTVGKCP<br>RYVKQTSLLLATGMRNVPEKPKTRGLFGAIAGFIENGWEGLIDGW<br>YGFRHQNAQGEGTAADYKSTQSAIDQITSKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHNCDDDQCMESIRNNT<br>YDHTQYRKESLQNRIQIDPVKLSSGYKDIILWFSFGASCFLLLAI<br>AMGLVFICIKNGNMRCTICI | 87 |
| AHA57072<br>A/turkey/<br>Minnesota/<br>18421/2009<br>2009/09/09<br>HA 558484465 | MNTQILALIACMLIGAKGDKICLGHHAVANGTKVNTLTERGIEVV<br>NATETVETANVKKICTQGKRPTDLGQCGLLGTLIGPPQCDQFLEF<br>DADLIIERREGTDVCYPGKFTNEESLRQILRGSGGIDKESMGFTY<br>SGIRTNGATSACRRSGSSFYAEMKWLLSNSNDAAFPQMTKSYRNP<br>RDKPALIIWGVHHSGSATEQTKLYGSGNKLITVGSSKYQQSFTPS<br>PGARPQVNGQSGRIDFHWLLLDPNDTVTFTFNGAFIAPDRASFFR<br>GESLGVQSDVPLDSGCEGDCFHSGGTIVSSLPFQNINPRTVGKCP<br>RYVKQTSLLLATGMRNVPEKPKTRGLFGAIAGFIENGWEGLIDGW<br>YGFRHQNAQGEGTAADYKSTQSAIDQITSKLNRLIDKTNQQFELI<br>DNEFSEIEQQIGNVINWTRDSMTEVWSYNAELLVAMENQHTIDLA<br>DSEMNKLYERVRKQLRENAEEDGTGCFEIFHKCDDDQCMESIRNNT<br>YDHTQYRKESLQNRIQIDPVKLSSGYKDIILWFSFGASCFLLLAI<br>AMGLVFICIKNGNMRCTICI | 88 |
| AHD25003<br>A/Guangdong/02/<br>2013 2013/10/<br>HA 568260567 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNM | 89 |
| AHF20528<br>A/Hong<br>Kong/470129/2013<br>2013/11/30<br>HA 570933555 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISSLPFQNIDSRAVGKCP | 90 |

TABLE 14-continued

H7 Hemagglutinin Amino Acid Sequences

| Accession No/<br>Strain/Protein | Amino Acid Sequence | SEQ<br>ID NO: |
|---|---|---|
| | RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AHF20568<br>A/Shanghai/<br>CN02/2013<br>2013/04/02 HA<br>570933626 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIMSNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 91 |
| AHH25185<br>A/Guangdong/<br>04/2013<br>2013/12/16 HA<br>576106234 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIEKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 92 |
| AHJ57411<br>A/Shanghai/<br>PD-01/2014<br>2014/01/17 HA<br>585478041 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVSS<br>PGARPQVNGLSGRIDFHWLMLNPNDTVTFSFNGAFIAPDRASFLR<br>GKSMGIQSGVQVDANCKGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRIIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 93 |
| AHJ57418<br>A/Shanghai/<br>PD-02/2014<br>2014/01/17 HA<br>585478256 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDICYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLK<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRIIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 94 |
| AHK10800<br>A/Shanghai/01/<br>2014<br>2014/01/03 HA<br>587681014 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRIIEKTNQQFELI<br>DNEFNEVEKQIGNVINWTRDSITEVWSYNAELLVAMENQHTIDLA | 95 |

TABLE 14-continued

H7 Hemagglutinin Amino Acid Sequences

| Accession No/<br>Strain/Protein | Amino Acid Sequence | SEQ<br>ID NO: |
|---|---|---|
| | DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AHM24224<br>A/Beijing/3/2013<br>2013/04/16<br>HA 594704802 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKEVKEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 96 |
| AHN96472<br>A/chicken/<br>Shanghai/PD-CN-<br>02/2014<br>2014/01/21 HA<br>602701641 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 97 |
| AHZ39686<br>A/Anhui/DEWH72-<br>01/2013<br>2013// HA<br>632807036 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDDAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 98 |
| AHZ39710<br>A/Anhui/DEWH72-<br>03/2013<br>2013// HA<br>632807076 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTDGATSACRRSGSSFYAEMKWLLSNTDDAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 99 |
| AHZ39746<br>A/Anhui/DEWH72-<br>06/2013<br>2013// HA<br>632807136 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGERPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 100 |

TABLE 14-continued

H7 Hemagglutinin Amino Acid Sequences

| Accession No/ Strain/Protein | Amino Acid Sequence | SEQ ID NO: |
|---|---|---|
| AHZ41929 A/mallard/ Sweden/1621/2002 2002/12/12 HA 632810949 | MNTQILVFALVAIIPTNADKICLGHHAVSNGTKVNTLTERGVEVV NATETVERTNVPRICSRGKRTVDLGQCGLLGTITGPPQCDQFLEF SADLIIERREGSDVCYPGKFVNEEALRQILRESGGIDKETMGFTY SGIRTNGATSACRRSGSSFYAEMKWLLSNTDNAAFPQMTKSYKNT RNDPALIIWGIHHSGSTTEQTKLYGSGNKLITVGSSNYQQSFVPS PGARPQVNGQSGRIDFHWLILNPNDTVTFSFNGAFIAPDRASFLR GKSMGIQSGVQIDANCEGDCYHSGGTIISNLPFQNINSRAVGKCP RYVKQESLLLATGMKNVPEIPKGRGLFGAIAGFIENGWEGLIDGW YGFRHQNAQGEGTAADYKSTQSAIDQITGKLNRLIEKTNQQFELI DNEFTEVEKQIGNVINWTRDSMTEVWSYNAELLVAMENQHTIDLA DSEMNKLYERVRRQLRENAEEDGTGCFEIFHKCDDDCMASIRNNT YDHSKYREEAMQNRIQIDPVKLSSGYKDVILWFSFGASCFILLAI AMGLVFMCVKNGNMRCTICI | 101 |
| AHZ42537 A/mallard/ Minnesota/ AI09-3770/2009 2009/09/12 HA 632811964 | MNTQILAFIACMLVGAKGDKICLGHHAVANGTKVNTLTERGIEVV NATETVETANIKKLCTQGKRPTDLGQCGLLGTLIGPPQCDQFLEF DADLIIERREGTDVCYPGKFTNEESLRQILRGSGGIDKESMGFTY SGIRTNGATSACRRSGSSFYAEMKWLLSNSDNAAFPQMTKSYRNP RNKPALIIWGVHHSGSATEQTKLYGSGNKLITVGSSKYQQSFTPS PGARPQVNGQSGRIDFHWLLLDPNDTVTFTFNGAFIAPDRASFER GESLGVQSDVPLDSGCEGDCFHSGGTIVSSLPFQNINPRTVGKCP RYVKQTSLLLATGMRNVPENPKTRGLFGAIAGFIENGWEGLIDGW YGFRHQNAQGEGTAADYKSTQSAIDQITGKLNRLIDKTNQQFELI DNEFSEIEQQIGNVINWTRDSMTELWSYNAELLVAMENQHTIDLA DSEMNKLYERVRKQLRENAEEDGTGCFEIFHKCDDQCMESIRNNT YDHTQYRTESLQNRIQIDPVKLSSGYKDIILWFSFGASCFLLLAI AMGLVFICIKNGNMRCTICI | 102 |
| AHZ42549 A/ruddy turnstone/ Delaware/AI00- 1538/2000 2000/05/20 HA 632811984 | MNTQILAFIACMLVGVRGDKICLGHHAVANGTKVNTLTEKGIEVV NATETVESANIKKICTQGKRPTDLGQCGLLGTLIGPPQCDQFLEF DSDLIIERREGTDVCYPGKFTNEESLRQILRGSGGIDKESMGFTY SGIRTNGATSACRRLGSSSFYAEMKWLLSNSDNAAFPQMTKSYRN PRNKPALIIWGVHHSGSANEQTKLYGSGNKLITVGSSKYQQSFTP SPGARPQVNGQSGRIDFHWLLLDPNDTVTFTFNGAFIAPDRASFF RGESLGIQSDVPLDSSCGGDCFHSGGTIVSSLPFQNINPRTVGKC PRYVKQTSLLLATGMRNVPENPKTRGLFGAIAGFIENGWEGLIDG WYGFRHQNAQGEGTAADYKSTQSAIDQITGKLNRLIDKTNQQFEL MDNEFNEIEQQIGNVINWTRDSMTEVWSYNAELLVAMENQHTIDL ADSEMNKLYERVRKQLRENAEEDGTGCFEIFHKCDDQCMESIRNN TYDHTQYRTESLQNRIQIDPVKLSSGYKDIILWFSFGASCFLLLA IAMGLIFICIKNGNMRCTICI | 103 |
| AID70634 A/Shanghai/ Mix1/2014 2014/01/03 HA 660304650 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRESGGIDKEAMGFTY SGIRTNGATSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSGGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRIIEKTNQQFELI DNEFNEVEKQISNVINWTRDSITEVWSYNAELLVAMENQHTIDLA DSEMDKLYERVRQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | 104 |
| AIN76383 A/Zhejiang/ LS01/2014 2014/02/08 HA 684694637 | MNTQILVFALIAIVPTNADKICLGHHAVSNGTKVNTLTERGVEVV NATETVERTNIPRICSKGKKTVDLGQCGLLGTITGPPQCDQFLEF SADLIIERREGSDVCYPGKFVNEEALRQILRESGGIDKEAMGFTY SGIRTNGITSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSGGTIISNLPFQNIDSRAVGKCP RYVKQSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITEVWSYNAELLVAMENQHTIDLA DSEMDKLYERVRKQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | 105 |
| AIU46619 A/chicken/ Zhejiang/DTID- ZJU06/2013 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRESGGIDKEAMGFTY SGIRTNGATSACRRSGSSFYAEMKWLLSNTDNAAFPQMTKSYKNT | 106 |

TABLE 14-continued

H7 Hemagglutinin Amino Acid Sequences

| Accession No/<br>Strain/Protein | Amino Acid Sequence | SEQ<br>ID NO: |
|---|---|---|
| 2013/12/<br>HA 699978931 | RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVEVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AIU47013<br>A/chicken/<br>Suzhou/040201H/<br>2013 2013/04/<br>HA 699979673 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDMILWFSFGASCFILLAI<br>VMGLVFICVKNGNMRCTICI | 107 |
| AJJ90490<br>A/chicken/<br>Shenzhen/742/2013<br>2013/12/10 HA<br>755178094 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RRSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 108 |
| AJJ90526<br>A/chicken/<br>Shenzhen/898/2013<br>2013/12/09 HA<br>755178154 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDICYPGKFVNEEALRQILRESGGIDKEAMGFTY<br>SGIRANGATSACKRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISSLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSRGYKDVILWFSFGASCFILLAI<br>VMGLVFICVKNGNMRCTICI | 109 |
| AJJ90538<br>A/silkie<br>chicken/<br>Shenzhen/918/2013<br>2013/12/09 HA<br>755178174 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 110 |
| AJJ90576<br>A/chicken/<br>Shenzhen/1665/2013<br>2013/12/12 HA<br>755178238 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDICYPGKFVNEEALRQILRESGGIDKEAMGFTY<br>SGIRANGATSACKRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI | 111 |

TABLE 14-continued

H7 Hemagglutinin Amino Acid Sequences

| Accession No/<br>Strain/Protein | Amino Acid Sequence | SEQ<br>ID NO: |
|---|---|---|
| | DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSRGYKDVILWFSFGASCFILLAI<br>VMGLVFICVKNGNMRCTICI | |
| AJJ90588<br>A/chicken/<br>Shenzhen/2110/2013<br>2013/12/13 HA<br>755178258 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RRSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSIGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 112 |
| AJJ90661<br>A/chicken/<br>Dongguan/2912/2013<br>2013/12/18 HA<br>755178380 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 113 |
| AJJ90673<br>A/silkie<br>chicken/<br>Dongguan/3049/2013<br>2013/12/18 HA<br>755178400 | MNTQILVFALTAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 114 |
| AJJ90795<br>A/silkie<br>chicken/<br>Dongguan/3281/2013<br>2013/12/18 HA<br>755178604 | MNTQILVFALIAIIPTNADKICLGHHAVPNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 115 |
| AJJ90891<br>A/silkie<br>chicken/<br>Dongguan/3520/2013<br>2013/12/19 HA<br>755178764 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKXPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 116 |

TABLE 14-continued

H7 Hemagglutinin Amino Acid Sequences

| Accession No/<br>Strain/Protein | Amino Acid Sequence | SEQ ID NO: |
|---|---|---|
| AJJ90951<br>A/chicken/<br>Dongguan/3544/2013<br>2013/12/19 HA<br>755178864 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYRNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 117 |
| AJJ91035<br>A/chicken/<br>Shenzhen/3780/2013<br>2013/12/19 HA<br>755179004 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RRSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDNRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 118 |
| AJJ91155<br>A/chicken/<br>Dongguan/4037/2013<br>2013/12/19 HA<br>755179204 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMNKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 119 |
| AJJ92005<br>A/chicken/<br>Shenzhen/801/2013<br>2013/12/09 HA<br>755180629 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSRGYKDVILWFSFGASCFILLAI<br>VMGLVFICVKNGNMRCTICI | 120 |
| AJJ94254<br>A/chicken/<br>Dongguan/1374/2014<br>2014/02/21 HA<br>755184382 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 121 |
| AJJ94606<br>A/chicken/<br>Dongguan/191/2014<br>2014/02/20 HA<br>755184968 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS | 122 |

TABLE 14-continued

H7 Hemagglutinin Amino Acid Sequences

| Accession No/<br>Strain/Protein | Amino Acid Sequence | SEQ<br>ID NO: |
|---|---|---|
| | PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ96552<br>A/chicken/<br>Jiangxi/12206/2014<br>2014/03/16 HA<br>755188219 | MNTQILVFALIAIIPTNADKICLGHHAVSNGTKVNTLTERGVEVV<br>NATETVERTNIPRICSKGKKTIDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHNKYREEAMQNRIQIDPVKLSSGYKDVILWFSFGASCFILLAI<br>VMGLVFICVKNGNMRCTICI | 123 |
| AJJ96684<br>A/chicken/<br>Jiangxi/13207/2014<br>2014/03/30 HA<br>755188439 | MNTQILVFALIAIIPTNADKICLGHHAVSNGTKINTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 124 |
| AJJ96732<br>A/chicken/<br>Jiangxi/13223/2014<br>2014/03/30 HA<br>755188519 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 125 |
| AJK00354<br>A/duck/Zhejiang/<br>LS02/2014<br>2014/01/12 HA<br>755194469 | MNTQILVFALVAIIPTNADKICLGHHAVSNGTKVNTLTERGVEVV<br>NATETVERTNIPRICSKGKKTVDLGQCGLLGTITGPPQCDQFLEF<br>SADLIVERREGSDVCYPGKFVNEEALRQILRESGGIDKEAMGFTY<br>SGIRTNGATSACRRSGSSFYAEMKWLLSNTDNAAFPQMTKSYKNT<br>RKDPALIIWGIHHSGSTTEQTKLYGSGNKLITVGSSNYQQSFVPS<br>PGARPLVNGQSGRIDFHWLMLNPNDTVTFSFNGAFIAPDRASFLR<br>GKSMGIQSGVQVDANCEGDCYHSGGTIISNLPFQNINSRAVGKCP<br>RYVKQESLLLATGMKNVPEVPKGRGLFGAIAGFIENGWEGLIDGW<br>YGFRHQNAQGEGTAADYKSTQSAIDQVIGKLNRLIEKTNQQFELI<br>DHEFTEVEKQIGNVINWTRDSMTEVWSYNAELLVAMENQHTIDLA<br>DSEMNKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 126 |
| AJJ91264<br>A/silkie<br>chicken/Dongguan/<br>4129/2013<br>2013/12/19 HA<br>755179386 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLMEKTNQQFELI<br>DNEFNEVEKQIGNVINWTRDSITEVWSYNAELLVAMENQHTIDLA | 127 |

TABLE 14-continued

H7 Hemagglutinin Amino Acid Sequences

| Accession No/Strain/Protein | Amino Acid Sequence | SEQ ID NO: |
|---|---|---|
| | DSEMDKLYERVKRQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | |
| AJJ91314 A/chicken/ Shaoxing/2417/2013 2013/10/20 HA 755179470 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRESGGIDKEAMGFTY SGIRTNGATSACRRSGSSFYAEMKWLLSNTDNAAFPQMTKSYKNT RKSPALIVWGIHHSVSTAEQTKLYGSGNKLVTVGSSNYQQSFVPS PGARPPVNGLSGRIDFHWLMLNPNDTVTFSFNGAFIAPDRASFLR GKSMGIQSGVQVDANCEGDCYHSGGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITEVWSYNAELLVAMENQHTIDLA DSEMDKLYERVKRQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | 128 |
| AJJ91402 A/chicken/ Huzhou/4045/2013 2013/10/24 HA 755179618 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRESGGIDKEAMGFTY SGIRTNGATSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSGGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITELWSYNAELLVAMENQHTIDLA DSEMDKLYERVKRQLRENAEEDGTGCFEIFHKCDDDCMASIRNNT YDHSKYREEAMQNRIQIDPVKLSSGYKEVILWFSFGASCFILLAI VMGLVFICVKNGNMRCTICI | 129 |
| AJJ91476 A/chicken/ Huzhou/4076/2013 2013/10/24 HA 755179743 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRKSGGIDKEAMGFTY SGIRTNGATSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSRGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITEVWSYNAELLVAMENQHTIDLA DSEMDKLYERVKRQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | 130 |
| AJJ91725 A/chicken/ Shaoxing/5201/2013 2013/10/28 HA 755180161 | MNTQILVFALIAIIPTNADKICLGHHAVSNGTKVNTLTERGVEVV NATETVERTNIPRICSKGKRTVDLGQCGLLGTITGPPQCDQFLEF SADLIIERREGSDVCYPGKFVNEEALRQILRESGGIDKEAMGFTY SGIRTNGATSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSGGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITELWSYNAELLVAMENQHTIDLA DSEMDKLYERVKRQLRENAEEDGTGCFEIFHKCDDDCMASIRNNT YDHSKYREEAMQNRIQIDPVKLSSGYKDVILWFSFGASCFILLAI VMGLVFICVKNGNMRCTICI | 131 |
| AJJ91885 A/Shenzhen/SP4/ 2014 2014/01/16 HA 755180429 | MNTQILVFALIAIIPTNADKICLGHHAVSNGTKVNTLTERGVEVV NATETVERTNIPRICSKGKKTVDLGQCGLLGTITGPPQCDQFLEF SADLIIERREGSDVCYPGKFVNEEALRQILRESGGIDKEAMGFTY SGIRANGVTSACRRSGSSFYAEMKWLLSNTDNAAFPQMTKSYKNT RKSPALIVWGIHHSVSTAEQTKLYGSGNKLVTVGSSNYQQSFVPS PGARPQVNGLSGRIDFHWLMLNPNDTVTFSFNGAFIAPDRASFLR GKSMGIQSGVQVDANCEGDCYHSGGTIISNLPFQNIDSRAVGKCP RYVKQRSLLLATGMKNVPEIPKGRGLFGAIAGFIENGWEGLIDGW YGFRHQNAQGEGTAADYKSTQSAIDQITGKLNRLIEKTNQQFELI DNEFNEVEKQIGNVINWTRDSITEVWSYNAELLVAMENQHTIDLA DSEMDKLYERVKRQLRENAEEDGTGCFEIFHKCDDDCMASIRNNT YDHSKYREEAMQNRIQIDPVKLSRGYKDVILWFSFGASCFILLAI VMGLVFICVKNGNMRCTICI | 132 |

TABLE 14-continued

H7 Hemagglutinin Amino Acid Sequences

| Accession No/<br>Strain/Protein | Amino Acid Sequence | SEQ<br>ID NO: |
|---|---|---|
| AJJ91909<br>A/Shenzhen/<br>SP26/2014<br>2014/01/20 HA<br>755180469 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDICYPGKFVNEEALRQILRESGGIDKEAMGFTY<br>SGIRANGATSACKRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISSLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDGCMASIRNNT<br>YDHSKYREEAMQNRIQIDPVKLSRGYKDVILWFSFGASCFILLAI<br>VMGLVFICVKNGNMRCTICI | 133 |
| AJJ91945<br>A/Shenzhen/<br>SP38/2014<br>2014/01/22 HA<br>755180529 | MNTQILAFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIGGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 134 |
| AJJ91957<br>A/Shenzhen/<br>SP44/2014<br>2014/01/23 HA<br>755180549 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRANGTTSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISSLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 135 |
| AJJ91969<br>A/Shenzhen/<br>SP48/2014<br>2014/01/23 HA<br>755180569 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 136 |
| AJJ91993<br>A/chicken/<br>Dongguan/4119/2013<br>2013/12/19 HA<br>755180609 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLLGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFTLLAI<br>VMGLVFICVKNGNMRCTICI | 137 |
| AJJ92031<br>A/chicken/<br>Dongguan/4064/2013<br>2013/12/19 HA | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT | 138 |

TABLE 14-continued

H7 Hemagglutinin Amino Acid Sequences

| Accession No/<br>Strain/Protein | Amino Acid Sequence | SEQ<br>ID NO: |
|---|---|---|
| 755180672 | RKSPALIVWGIHHSVSTAEQTKLYGSGNKLVTVESSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ92967<br>A/silkie<br>chicken/Jiangxi/<br>9469/2014<br>2014/02/16 HA<br>755182232 | MNTQILVFALIAIVPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGVISACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 139 |
| AJJ93027<br>A/chicken/Jiangxi/<br>9558/2014<br>2014/02/16 HA<br>755182332 | MNTQILVFALIAIVPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKEVKEEALRQILRESGGIDKEAMGFTY<br>SGIRTNGVISACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 140 |
| AJJ93051<br>A/chicken/Jiangxi/<br>10573/2014<br>2014/02/18 HA<br>755182372 | MNTQILVFALIAIVPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGVISACRRSGSSFYAEMKWLLSNIDDAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 141 |
| AJJ93845<br>A/silkie<br>chicken/Dongguan/<br>157/2014<br>2014/02/20 HA<br>755183695 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 142 |
| AJJ93857<br>A/chicken/<br>Dongguan/169/2014<br>2014/02/20 HA<br>755183715 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACMRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI | 143 |

TABLE 14-continued

H7 Hemagglutinin Amino Acid Sequences

| Accession No/<br>Strain/Protein | Amino Acid Sequence | SEQ<br>ID NO: |
|---|---|---|
| | DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ93869<br>A/chicken/<br>Dongguan/173/2014<br>2014/02/20 HA<br>755183735 | MNTQILVFALIAIIPTNADKICLGHHAVSNGTKVNTLTERGVEVV<br>NATETVERTNIPRICSKGKKTVDLGQCGLLGTVTGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 144 |
| AJJ93881<br>A/chicken/<br>Dongguan/189/2014<br>2014/02/20 HA<br>755183755 | MNTQILVFALIAIIPTNADKICLGHHAVSNGTKVNTLTERGVEVV<br>NATETVERTNIPRICSKGKKTVDLGQCGLLGTVTGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>KYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 145 |
| AJJ93907<br>A/chicken/<br>Dongguan/449/2014<br>2014/02/20 HA<br>755183799 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 146 |
| AJJ93931<br>A/chicken/<br>Dongguan/536/2014<br>2014/02/20 HA<br>755183839 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISKLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 147 |
| AJJ93943<br>A/chicken/<br>Dongguan/568/2014<br>2014/02/20 HA<br>755183859 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIEKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 148 |

TABLE 14-continued

H7 Hemagglutinin Amino Acid Sequences

| Accession No/<br>Strain/Protein | Amino Acid Sequence | SEQ<br>ID NO: |
|---|---|---|
| AJJ93979<br>A/silkie<br>chicken/Dongguan/<br>656/2014<br>2014/02/20 HA<br>755183919 | MNTQILVFALIAIIPTNADKICLGHHAVSNGTKVNTLTERGVEVV<br>NATETVERTNIPRICSKGKKTVDLGQCGLLGTVTGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFGLI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 149 |
| AJJ94134<br>A/chicken/<br>Dongguan/1051/2014<br>2014/02/21 HA<br>755184182 | MNTQILVLALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVXLSXGYKDVILWFSFGASCFILLAI<br>VMGLVFICVKNGNMRCTICI | 150 |
| AJJ94158<br>A/chicken/<br>Dongguan/1075/2014<br>2014/02/21 HA<br>755184222 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYRGEAMQNRIQIDPVKLSSGYKDVILWFSFGASCFILLAI<br>VMGLVFICVKNGNMRCTICI | 151 |
| AJJ94182<br>A/chicken/<br>Dongguan/1177/2014<br>2014/02/21 HA<br>755184262 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACKRSGSSFYAEMKWLLSNTDNAAFPQMTKSYKNT<br>RKSPALIVWGIHHSVSIAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 152 |
| AJJ94194<br>A/silkie<br>chicken/Dongguan/<br>1264/2014<br>2014/02/21 HA<br>755184282 | MNTQILVFALIAIIPTNADKICLGHHAVSNGTKVNTLTERGVEVV<br>NATETVERTNIPRICSKGKKTIDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQVIGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYRGEAMQNRIQIDPVKLSSGYKDVILWFSFGASCFMLLAI<br>VMGLVFICVKNGNMRCTICI | 153 |
| AJJ94206<br>A/silkie<br>chicken/Dongguan/<br>1268/2014 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT | 154 |

TABLE 14-continued

H7 Hemagglutinin Amino Acid Sequences

| Accession No/<br>Strain/Protein | Amino Acid Sequence | SEQ<br>ID NO: |
|---|---|---|
| 2014/02/21 HA<br>755184302 | RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISDLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ94344<br>A/silkie<br>chicken/Dongguan/<br>1451/2014<br>2014/02/21 HA<br>755184532 | MNTQILVFALIAIIPTNADKICLGHHAVSNGTKVNTLTERGVEVV<br>NSTETEVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRTVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 155 |
| AJJ94356<br>A/chicken/<br>Dongguan/1456/2014<br>2014/02/21 HA<br>755184552 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 156 |
| AJJ94396<br>A/chicken/<br>Dongguan/1494/2014<br>2014/02/21 HA<br>755184618 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPETPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 157 |
| AJJ94754<br>A/chicken/<br>Dongguan/748/2014<br>2014/02/20 HA<br>755185215 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIEKEAMGFTY<br>SGIRANGATSACRRSGSSFYAEMKWLLSNTDNAAFPQMTKSYKNT<br>RKSPALIVWGIHHSVSNAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 158 |
| AJJ94838<br>A/chicken/<br>Dongguan/835/2014<br>2014/02/20 HA<br>755185356 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSASTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI | 159 |

TABLE 14-continued

H7 Hemagglutinin Amino Acid Sequences

| Accession No/<br>Strain/Protein | Amino Acid Sequence | SEQ<br>ID NO: |
|---|---|---|
| | DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFGFGASCFILLAI<br>VMGLVFICVKNGNMRCTICI | |
| AJJ94862<br>A/chicken/<br>Dongguan/843/2014<br>2014/02/20 HA<br>755185396 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIEKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSGGYKDVILWFSFGASCFILLAI<br>VMGLVFICVKNGNMRCTICI | 160 |
| AJJ94886<br>A/chicken/<br>Dongguan/851/2014<br>2014/02/20 HA<br>755185436 | MNTQILAFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 161 |
| AJJ94910<br>A/chicken/<br>Dongguan/874/2014<br>2014/02/20 HA<br>755185476 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSASTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 162 |
| AJJ94959<br>A/silkie<br>chicken/Dongguan/<br>967/2014<br>2014/02/21 HA<br>755185558 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACXRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 163 |
| AJJ95048<br>A/chicken/<br>Dongguan/1009/2014<br>2014/02/21 HA<br>755185708 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPETPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDNDCMASIRNNT<br>YDHSKYREEAMQNRIQIDPVKLSSGYKDVILWFSFGASCFILLAI<br>VMGLVFICVKNGNMRCTICI | 164 |

TABLE 14-continued

H7 Hemagglutinin Amino Acid Sequences

| Accession No/<br>Strain/Protein | Amino Acid Sequence | SEQ<br>ID NO: |
|---|---|---|
| AJJ95171<br>A/chicken/<br>Dongguan/1314/2014<br>2014/02/21 HA<br>755185913 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVIFNFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 165 |
| AJJ95227<br>A/chicken/<br>Dongguan/1382/2014<br>2014/02/21 HA<br>755186006 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDICYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 166 |
| AJJ95251<br>A/chicken/<br>Dongguan/1401/2014<br>2014/02/21 HA<br>755186046 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYKRVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 167 |
| AJJ95346<br>A/chicken/<br>Dongguan/1548/2014<br>2014/02/21 HA<br>755186206 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYKRVKRQLRENAEEDGTGCFEIFHKCDDDCMASIRNNT<br>YDHNKYREEAMQNRIQIDPVKLSSGYKDVILWFSFGASCFILLAI<br>VMGLVFICVKNGNMRCTICI | 168 |
| AJJ95382<br>A/chicken/<br>Dongguan/1690/2014<br>2014/02/21 HA<br>755186266 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSIGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 167 |
| AJJ95464<br>A/chicken/<br>Shenzhen/138/2014<br>2014/02/19 HA<br>755186404 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS | 170 |

TABLE 14-continued

H7 Hemagglutinin Amino Acid Sequences

| Accession No/<br>Strain/Protein | Amino Acid Sequence | SEQ<br>ID NO: |
|---|---|---|
| | PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYRGEAMQNRIQIDPVKLSSGYKDVILWFSFGASCFMLLAI<br>VMGLVFICVKNGNMRCTICI | |
| AJJ95572<br>A/chicken/<br>Dongguan/1100/2014<br>2014/02/21 HA<br>755186584 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIEKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSGGYKDVILWFSFGASCFILLAI<br>VMGLVFICVKNGNMRCTICI | 171 |
| AJJ95584<br>A/silkie<br>chicken/Dongguan/<br>1519/2014<br>2014/02/21 HA<br>755186604 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPERASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYRGEAMQNRIQIDPVKLSSGYKDVILWFSFGASCFMLLAI<br>VMGLVFICVKNGNMRCTICI | 172 |
| AJJ95596<br>A/Shenzhen/<br>SP58/2014<br>2014/01/25 HA<br>755186624 | MNTQILAFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRANGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 173 |
| AJJ95620<br>A/Shenzhen/<br>SP75/2014<br>2014/02/15 HA<br>755186664 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGSTSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAV<br>VMGLVFICVKNGNMRCTICI | 174 |
| AJJ95632<br>A/Shenzhen/<br>SP62/2014<br>2014/02/05 HA<br>755186684 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNATFPQMTKSYKNT<br>RKSPALIIWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVETQIGNVINWTRDSITEVWSYNAELLVAMENQHTIDLA | 175 |

TABLE 14-continued

H7 Hemagglutinin Amino Acid Sequences

| Accession No/<br>Strain/Protein | Amino Acid Sequence | SEQ<br>ID NO: |
|---|---|---|
| | DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ96720<br>A/chicken/Jiangxi/<br>13220/2014<br>2014/03/30 HA<br>755188499 | MNTQILVFALIAIIPTNADKICLGHHAVSNGTKVNTLTERGVEVV<br>NATETVERTTIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSRGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 176 |
| AJJ96817<br>A/chicken/Jiangxi/<br>9513/2014<br>2014/02/16 HA<br>755188661 | MNTQILVFALIAIVPTNADKICLGHHAVSNGTKVNTLTERGVEVV<br>NATEIVERTNIPRICSKGKKTVDLGQCGLLGTITGPPQCDQFLEF<br>SADLIIERREGSDVCYPGKFVNEEALRQILRESGGIDKEAMGFTY<br>SGIRTNGVISACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 177 |
| AJJ96841<br>A/Shenzhen/<br>SP139/2014<br>2014/04/02 HA<br>755188701 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSTCRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRACFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVERQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 178 |
| AJJ96889<br>A/chicken/<br>Jiangxi/13496/2014<br>2014/04/11 HA<br>755188781 | MNTQILVFALIAIIPTNADKICLGHHAVSNGTKVNTLTERGVEVV<br>NATETVERIXIPRICSKGKKTVDLGQCGLLGTITGPPQCDQFLEF<br>SADLIIERREGSDVCYPGKFVNEEALRQILRESGGIDKXAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSXGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 179 |
| AJJ96901<br>A/chicken/<br>Jiangxi/13502/2014<br>2014/04/11 HA<br>755188801 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSXGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 180 |

TABLE 14-continued

H7 Hemagglutinin Amino Acid Sequences

| Accession No/<br>Strain/Protein | Amino Acid Sequence | SEQ<br>ID NO: |
|---|---|---|
| AJJ96925<br>A/chicken/<br>Jiangxi/13513/2014<br>2014/04/11 HA<br>755188841 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>NGIRINGATSACRRSGSSFYAEMKWLLSNTDNAAFPQMTKSYKNT<br>RKSPAIIVWGIHHTVSTAEQTKLYGSGNKLVTVGSSNYQQSFVPS<br>PGARPQVNGLSGRIDLHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 181 |
| AJJ97267<br>A/chicken/<br>Jiangxi/13252/2014<br>2014/03/30 HA<br>755189411 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 182 |
| AJJ97291<br>A/chicken/<br>Jiangxi/13493/2014<br>2014/04/06 HA<br>755189451 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>NGIRINGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 183 |
| AJJ97331<br>A/chicken/<br>Jiangxi/13512/2014<br>2014/04/06 HA<br>755189517 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>NGIRINGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSIGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 184 |
| AJJ97373<br>A/chicken/<br>Jiangxi/13521/2014<br>2014/04/06 HA<br>755189587 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>NGIRINGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPXRASFLR<br>GKSXGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 185 |
| AJJ97443<br>A/chicken/<br>Jiangxi/13530/2014<br>2014/04/06 HA | MNTQILVFALIAIIPTNADKICLGHHAVSNGTKVNTLTERGVEVV<br>NATETVERTTIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT | 186 |

TABLE 14-continued

H7 Hemagglutinin Amino Acid Sequences

| Accession No/<br>Strain/Protein | Amino Acid Sequence | SEQ<br>ID NO: |
|---|---|---|
| 755189702 | RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSRGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ97582<br>A/chicken/<br>Jiangxi/14023/2014<br>2014/04/13 HA<br>755189933 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 187 |
| AJJ97697<br>A/chicken/<br>Jiangxi/14517/2014<br>2014/04/20 HA<br>755190125 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCDGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 188 |
| AJJ97709<br>A/chicken/<br>Jiangxi/14518/2014<br>2014/04/20 HA<br>755190145 | MNTQILVFALIAIIPANADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>NGIRINGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGNCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFICVKNGNMRCTICI | 189 |
| AJJ97745<br>A/chicken/<br>Jiangxi/14554/2014<br>2014/04/20 HA<br>755190205 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELM<br>DNEFNEVEKQIGNVINWTRDSITELWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 190 |
| AJJ97757<br>A/chicken/<br>Shantou/2537/2014<br>2014/04/16 HA<br>755190225 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEIPKGRGLFGAIAGFIENGWEGLIDGW<br>YGFKHQNAQGEGTAADYKSTQSAIDQITGKLNRLIEKTNQQFELI | 191 |

TABLE 14-continued

H7 Hemagglutinin Amino Acid Sequences

| Accession No/<br>Strain/Protein | Amino Acid Sequence | SEQ ID NO: |
|---|---|---|
| | DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | |
| AJJ97841<br>A/duck/Jiangxi/<br>15044/2014<br>2014/04/27 HA<br>755190365 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVRLSSGYKDVILWFSFGASCFILLAI<br>VMGLVFICVKNGNMRCTICI | 192 |
| AJJ97899<br>A/chicken/Jiangxi/<br>15524/2014<br>2014/05/05 HA<br>755190462 | MNTQILVFALIAIIPTNADKICLGHHAVSNGTKVNTLTERGVEVV<br>NATETVERTNIPRICSKGKRTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQRSLLLATGMKNVPEIPKGRGLFGAIAGFIENGWEGLIDGW<br>YGFRHQNAQGEGTAADYKSTQSAIDQITGKLNRLIAKINQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHRKYREEAMQNRIQIDPVKLSSGYKDVILWFSFGASCFILLAI<br>VMGLVFMCVKNGNMRCTICI | 193 |
| AJJ97925<br>A/silkie<br>chicken/Shantou/<br>2050/2014<br>2014/03/25 HA<br>755190506 | MNTQILVFALIAIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGATSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEVPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 194 |
| AJJ97973<br>A/chicken/Shantou/<br>4325/2014<br>2014/07/01 HA<br>755190586 | MNTQILVFALISIIPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRKSGGIDKEAMGFTY<br>SGIRTNGVTSACRRSGSSFYAEMKWLLSNTDNAAFPQMTKSYKNT<br>RKSPAIIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDADCEGDCYHSGGTIISNLPFQNIDSRAVGKCP<br>RYVKQRSLLLATGMKNVPEVPKGRGLFGAIAGFIENGWEGLIDGW<br>YGFRHQNAQGEGTAADYKSTQSAIDQITGKLNRLIEKTNQQFELI<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 195 |
| AJJ97998<br>A/chicken/Shantou/<br>4816/2014<br>2014/07/22 HA<br>755190628 | MNTQILVFALIAIVPTNADKICLGHHAVSNGTKVNTLTERGVEVV<br>NATETVERTNIPRICSKGKKTVDLGQCGLLGTITGPPQCDQFLEF<br>SADLIIERREGSDVCYPGKFVNEEALRQILRESGGIDKEAMGFTY<br>SGIRTNGATSACRRSGSSFYAEMKWLLSNTDNAAFPQMTKSYKNT<br>RKSPALIVWGIHHSVSTAEQTKLYGSGNKLVTVGSSNYQQSFVPS<br>PGARPQVNGLSGRIDFHWLMLNPNDTVTFSFNGAFIAPDRASFLR<br>GKSMGIQSGVQVDANCEGDCYHSGGTIISNLPFQNIDSRAVGKCP<br>RYVKQKSLLLATGMKNVPEIPKGRGLFGAIAGFIENGWEGLIDGW<br>YGFRHQNAQGEGTAADYKSTQSAIDQITGKLNRLIEKTNQQFELV<br>DNEFNEVEKQIGNVINWTRDSITEVWSYNAELLVAMENQHTIDLA<br>DSEMDKLYERVKRQLRENAEEDGTGCFEIFHKCDDDCMASIRNNT<br>YDHSKYREEAMQNRIQIDPVKLSSGYKDVILWFSFGASCFILLAI<br>VMGLVFICVKNGNMRCTICI | 196 |

TABLE 15

H10 Hemagglutinin Amino Acid Sequences

| SEQ ID NO: | Accession No/ Strain/Protein | Amino Acid Sequence | SEQ ID NO: |
|---|---|---|---|
| | AAM19228 A/turkey/ Minnesota/ 38429/1988 1988// HA 20335017 | ACVLVEAKGDKICLGHHAVVNGTKVNTLTEKGIEVVN ATETVETANIGKICTQGKRPTDLGQCGLLGTLIGPPQ CDQFLEFESDLIIERREGNDVCYPGKFTNEESLRQIL RGSGGIDKESMGFTYSGIITNGATSACRRSGSSFYAE MKWLLSNSDNAAFPQMTKSYRNPRNKPALIVWGIHHS GSTTEQTKLYGSGNKLITVESSKYQQSFTPSPGARPQ VNGESGRIDFHWMLLDPNDTVTFTFNGAFIAPDRASF FKGESLGVQSDVPLDSSCGGDCFHSGGTIVSSLPFQN INPRTVGKCPRYVKQPSLLLATGMRNVPENPKTRGLF GAIAGFIEKDGGSHYG | 197 |
| | AAY46211 A/mallard/ Sweden/ 91/2002 2002// HA 66394828 | MNTQILVFALVAIIPTNADKICLGHHAVSNGTKVNTL TERGVEVVNATETVERTNVPRICSRGKRTVDLGQCGL LGTITGPPQCDQFLEFSADLIIERREGSDVCYPGKFV NEEALRQILRESGGIDKETMGFTYSGIRTNGAPSACR RSGSSFYAEMKWLLSNTDNAAFPQMTKSYKNTRNDPA LIIWGIHHSGSTTEQTKLYGSGNKLITVGSSNYQQSF VPSPGARPQVNGQSGRIDFHWLILNPNDTVTFSFNGA FIAPDRASFLRGKSMGIQSGVQIDANCEGDCYHSGGT IISNLPFQNINSRAVGKCPRYVKQESLLLATGMKNVP EIPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVKLS SGYKDVILWFSFGASCFILLAIAMGLVFMCVKNGNMR CTICI | 198 |
| | ABI84694 A/turkey/ Minnesota/1/1988 1988/07/13 HA 115278573 | MNTQILVFIACVLVEAKGDKICLGHHAVVNGTKVNTL TEKGIEVVNATETVETANIGKICTQGKRPTDLGQCGL LGTLIGPPQCDQFLEFESDLIIERREGNDVCYPGKFT NEESLRQILRGSGGIDKESMGFTYSGIRTNGATSACR RSGSSFYAEMKWLLSNSDNAAFPQMTKSYRNPRNKPA LIVWGIHHSGSTTEQTKLYGSGNKLITVGSSKYQQSF TPSPGARPQVNGQSGRIDFHWMLLDPNDTVTFTFNGA FIAPDRASFFKGESLGVQSDVPLDSSCGGDCFHSGGT IVSSLPFQNINPRTVGKCPRYVKQPSLLLATGMRNVP ENPKTRGLFGAIAGFIENGWEGLIDGWYGFKHQNAQG EGTAADYKSTQSAIDQITGKLNRLIDKTNQQFELIDN EFSEIEQQIGNVINWTRDSMTEVWSYNAELLVAMENQ HTIDLADSEMNKLYERVRRQLRENAEEDGTGCFEIFH KCDDQCMESIRNNTYDHAQYRAESLQNRIQIDPVKLS SGYKDIILWFSFGASCFLLLAIAMGLVFICIKNGNMR CTICI | 199 |
| | ABS89409 A/blue-winged teal/Ohio/566/ 2006 2006// HA 155016324 | MNTQILALIACMLIGAKGDKICLGHHAVANGTKVNTL TERGIEVVNATETVETANIKKICTQGKRPTDLGQCGL LGTLIGPPQCDQFLEFDTDLIIERREGTDVCYPGKFT NEESLRQILRGSGGIDKESMGFTYSGIRTNGATSACR RSGSSFYAEMKWLLSNSDNAAFPQMTKSYRNPRNKPA LIIWGVHHSGSATEQTKLYGSGNKLITVGSSKYQQSF TPSPGARPQVNGQSGRIDFHWLLLDPNDTVTFTFNGA FIAPDRASFERGESLGVQSDVPLDSGCEGDCFHSGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRTESLQNRIQIDPVRLS SGYKDIILWFSFGASCFLLLAIAMGLVFICIKNGNMR CTICI | 200 |
| | ACD03594 A/ruddy turnstone/DE/ 1538/2000 2000// HA 187384848 | MNTQILAFIACMLVGVRGDKICLGHHAVANGTKVNTL TEKGIEVVNATETVESANIKKICTQGKRPTDLGQCGL LGTLIGPPQCDQFLEFDSDLIIERREGTDVCYPGKFT NEESLRQILRGSGGIDKESMGFTYSGIRTNGATSACR RLGSSFYAEMKWLLSNSDNAAFPQMTKSYRNPRNKPA LIIWGVHHSGSANEQTKLYGSGNKLITVGSSKYQQSF TPSPGARPQVNGQSGRIDFHWLLLDPNDTVTFTFNGA FIAPDRASFERGESLGIQSDVPLDSSCGGDCFHSGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELMDN EFNEIEQQIGNVINWTRDSMTEVWSYNAELLVAMENQ HTIDLADSEMNKLYERVRKQLRENAEEDGTGCFEIFH | 201 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | KCDDQCMESIRNNTYDHTQYRTESLQNRIQIDPVKLS SGYKDIILWFSFGASCFLLLAIAMGLIFICIKNGNMR CTICI | |
| | BAH22785 A/duck/Mongolia/ 119/2008 2008// HA 223717820 | MNTQILVFALVAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIGKETMGFTYSGIRTNGATSACR RSGSSFYAEMKWLLSNTDNAAFPQMTKSYKNTRKDPA LIIWGIHHSGSTTEQTKLYGSGNKLITVGSSNYQQSF VPSPGARPQVNGQSGRIDFHWLMLNPNDTVTFSFNGA FIAPDRASFLRGKSMGIQSGVQVDANCEGDCYHNGGT IISNLPFQNINSRTVGKCPRYVKQESLLLATGMKNVP EIPKGRGLFGAIAGFIENGWEGLIDGWYGFRHQNAQG EGTAADYKSTQSAIDQITGKLNRLIERTNQQFELIDN EFTEVEKQIGNVINWTRDSMTEVWSYNAELLVAMENQ HTIDLADSEMNKLYERVKRQLRENAEEDGTGCFEIFH KCDDDCMASIRNNTYDHSKYREEAMQNRIQIDPVKLS NGYKDVILWFSFGASCFILLAIAMGLVFICVKNGNMR CTICI | 202 |
| | CAY39406 A/Anas crecca/ Spain/ 1460/2008 2008/01/26 HA 254674376 | MNTQILVFALVAIIPTNADKICLGHHAVSNGTKVNTL TERGVEVVNATETVERTNVPRICSKGKRTVDLGQCGL LGTITGPPQCDQFLEFSADLIIERREGSDVCYPGKFV NEEALRQILRESGGIDKETMGFTYSGIRTNGATSACR RSGSSFYAEMKWLLSNTDNAAFPQMTKSYKNTRKDPA LIIWGIHHSGSTTEQTKLYGSGSKLITVGSSNYQQSF VPSPGARPQVNGQSGRIDFHWLMLNPNDTVTFSFNGA FIAPDRASFLRGKSMGIQSGVQVDANCEGDCYHSGGT IISNLPFQNINSRAVGKCPRYVKQESLMLATGMKNVP EIPKGRGLFGAIAGFIENGWEGLIDGWYGFRHQNAQG EGTAADYKSTQSAIDQITGKLNRLIEKTNQQFELIDN EFTEVEKQIGNVINWTRDSITEVWSYNAELLVAMENQ HTIDLADSEMNKLYERVKRQLRENAEEDGTGCFEIFH KCDDDCMASIRNNTYDHSKYREEAMQNRIQIDPVKLS SGYKDVILWFSFGASCFILLAIAMGLVFICVKNGNMR CTICI | 203 |
| | ACX53683 A/goose/Czech Republic/1848- K9/2009 2009/02/04 HA 260907763 | MNTQILVFALVAIIPTNADKICLGHHAVSNGTKVNTL TERGVEVVNATETVERTNVPRICSKGKRTVDLGQCGL LGTITGPPQCDQFLEFSADLIIERRGGSDVCYPGKFV NEEALRQILRESGGIDKETMGFTYSGIRTNGATSACR RSGSSFYAEMKWLLSNTDNAAFPQMTKSYKNTRKDPA LIIWGIHHSGSTTEQTKLYGSGSKLITVGSSNYQQSF VPSPGARPQVNGQSGRIDFHWLMLNPNDTVTFSFNGA FIAPDRASFLKGKSMGIQSGVQVDANCEGDCYHSGGT IISNLPFQNINSRAVGKCPRYVKQESLMLATGMKNVP ELPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVKRQLRENAEEDGTGCFEIFH KCDDDCMASIRNNTYDHSKYREEAMQNRIQINPVKLS SGYKDVILWFSFGASCFILLAIAMGLVFICVKNGNMR CTICI | 204 |
| | ACZ48625 A/turkey/ Minnesota/38429/ 1988 1988// HA 269826341 | MNTQILVFIACVLVEAKGDKICLGHHAVVNGTKVNTL TEKGIEVVNATETVETANIGKICTQGKRPTDLGQCGL LGTLIGPPQCDQFLEFESDLIIERRENGDVCYPGKFT NEEESLRQILRGSGGIDKESMGFTYSGIRTNGATSACR RSGSSFYAEMKWLLSNSDNAAFPQMTKSYRNPRNKPA LIVWGIHHSGSTTEQTKLYGSGNKLITVGSSKYQQSF TPSPGARPQVNGQSGRIDFHWMLLDPNDTVTFTFNGA FIAPDRASFFKGESLGVQSDVPLDSSCGGDCFHSGGT IVSSLPFQNINPRTVGKCPRYVKQPSLLLATGMRNVP ENPKTRGLFGAIAGFIENGWEGLIDGWYGFKHQNAQG EGTAADYKSTQSAIDQITGKLNRLIDKTNQQFEL | 205 |
| | ADC29485 A/mallard/Spain/ 08.00991.3/ 2005 2005/11/ HA 284927336 | STQSAIDQITGKLNRLIEKTNQQFELIDNEFTEVEKQ IGNVINWTRDSMTEVWSYNAELLVAMENQHTIDLADS EMNKLYERVKRQLRENAEEDGTGCFEIFHKCDDDCMA SIRNNTYDHSKYREEAMQNRIQIDPVKLSSGYKDVIL WFSFGASCFILL | 206 |
| | ADK71137 A/blue-winged | MNTQILALIACMLIGAKGDKICLGHHAVANGTKVNTL TERGIEVVNATETVETANIKKICTQGKRPTDLGQCGL | 207 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| teal/Guatemala/ CIP049- 01/2008 2008/02/07 HA 301333785 | LGTLIGPPQCDQFLEFDADLIIERREGTDVCYPGKFT NEESLRQILRGSGGIDKESMGFTYSGIRTNGATSACR RSGSSSYAEMKWLLSNSDNAAFPQMTKSYRNPRNKPA LIIWGVHHSGSATEQTKLYGSGNKLITVGSSKYQQSF TPSPGIRPQVNGQSGRIDFHWLLLDPNDTVTFTFNGA FIAPDRASFLRGKSLGIQSDVPLDSGCEGDCFHSGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQHFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRTESLQNRIQIDPVKLS SGYKDIILWFSFGASCFLLLAIAMGLVFICIKNGNMR CTICI | |
| ADK71148 A/blue-winged teal/Guatemala/ CIP049- 02/2008 2008/03/05 HA 301333804 | MNTQILALIACMLIGAKGDKICLGHHAVANGTKVNTL TERGIEVVNXTETVETANIKKICTHGKRPTDLGQCGL LGTLIGPPQCDRFLEFDADLIIERREGTDVCYPGKFT NEESLRQILRGSGGIDKESMGFTYSGIRTNGATSACR RSGSSFYAEMKWLLSNSDNAAFPQMTKSYRNPRNKPA LIIWGVHHSGSATEQTKLYGSGNKLITVGSSKYQQSF TPSPGIRPQVNGQSGRIDFHWLLLDPNDTVTFTFNGA FIAPDRASFLRGKSLGIQSDVPLDSGCEGDCFHSGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRTESLQNRIQIDPVKLS SGYKDIILWFSFGASCFLLLAIAMGLVFICIKNGNMR CTICI | 208 |
| ADN34727 A/goose/Czech Republic/1848- T14/2009 2009/02/04 HA 307141869 | MNTQILVFALVAIIPTNADKICLGHHAVSNGTKVNTL TERGVEVVNATETVERTNVPRICSKGKRTVDLGQCGL LGTITGPPQCDQFLEFSADLIIERRGGSDVCYPGKFV NEEALRQILRESGGIDKETMGFTYSGIRINGXTSACR RSGSSFYAEMKWLLSNTDNAAFPQMTKSYKNTRKDPA LIIWGIHHSGSTTEQTKLYGSGSKLITVGSSNYQQSF VPSPGARPQVNGQSGRIDFHWLMLNPNDTVTFSFNGA FIAPDRASFLRGKSMGIQSGVQVDANCEGDCYHSGGT IISNLPFQNINSRAVGKCPRYVKQESLMLATGMKNVP ELPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVKRQLRENAEEDGTGCFEIFH KCDDDCMASIRNNTYDHSKYREEAMQNRIQINPVKLS SGYKDVILWFSFGASCFILLAIAMGLVFICVKNGNMR CTICI | 209 |
| AEK84760 A/wild bird/Korea/A14/ 2011 2011/02/ HA 341610308 | PAFIAPDRASFLRGKSMGIQSGVQVDASCEGDCYHSG GTIISNLPFQNINSRAVGKCPRYVKQESLMLATGMKN VPELPKGRGLFGAIAGFIENGWEGLIDGWYGFRHQNA QGEGTAADYKSTQSAIDQITGKLNRLIEKTNQQFELI DNEFTEVEKQIGNVINWTRDSMTEVWSYNAELLVAME NQHTIDLADSEMNKLYERVRRQLRENAEEDGTGCFEI FHKCDDDCMASIRNNTYDHSKYREEAMQNRIQIDPVK LSSGYKDVILWFSFGASCFILLAIAMGLVFICVKNGN MRCTICI | 210 |
| AEK84761 A/wild bird/Korea/A3/ 2011 2011/02/ HA 341610310 | ILVFALVAIIPTNANKIGLGHHAVSNGTKVNTLTERG VEVFNATETVERTNVPRICSKGKKTVDLGQCGLRGTI TGPPQCDQFLKFSPDLIIERQKGSDVCYPGKFVNEKP LRQILRESGGIDKETMGFAYNGIKTNGPPIACRKSGS SFYAKMKWLLSNTDKAAFPQMTKSYKNTRRNPALIVW GIHHSGSTTKQTKLYGIGSNLITVGSSNYQQSFVPSP GARPQVNGQSGRIDFHWLILNPNDTVTFSFNGAFIPP DRASFLRGKSMGIQSGVQVDASCEGDCYHSGGTIISN LPFQNINSRAVGKCPRYVKQESLMLATGMKNVPELPK GKGLFGAIAGFIENGWEGLIDGWYGFRHQNAQGEGTA ADYKSTQSAIDQITGKLNRLIEKTNQQFELIDNEFTE VEKQIGNVINWTRDSMTEVWSYNAELLVAMENQHTID LADSEMNKLYERVRRQLRENAEEDGTGCFEIFHKCDD DCMASIRNNTYDHSKYREEAMQNRIQIDPVKLSSGYK DVILWFSFGASCFILLAIAMGLVFICVKNGNMRCTIC I | 211 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | AEK84763 A/wild bird/Korea/A9/ 2011 2011/02/ HA 341610314 | ILVFALVAIIPTNANKIGLGHHAVSNGTKVNTLTERG VEFFNATETVEPINVPRICSKGKKTVDLGQCGLLGTI TGPPQCDQFLEFSADLIIERREGSDVCYPGKFVNEKA LRQILRESGGIDKETMGFAYSGIKTNGPPIACRKSGS SFYAKMKWLLSNTDKAAFPQMTKSYKNTRRDPALIVW GIHHSGSTIKQINLYGIGSNLITVGSSNYQQSFVPSP GARPQVNGQSGRIDFHWLILNPNDTVTFIFNGAFIAP DRASFLIGKSMGIQSGVQVDASCEGDCYHSGGTIISN LPFQNINSRAVGKCPRYVKQESLMLATGMKNVPELPK GRGLFGAIAGFIENGWEGLIDGWYGFRHQNAQGEGTA ADYKSTQSAIDQITGKLNRLIEKTNQQFELIDNEFTE VEKQIGNVINWTRDSMTEVWSYNAELLVAMENQHTID LADSEMNKLYERVRRQLRENAEEDGTGCFEIFHKCDD DCMASIRNNTYDHSKYREEAMQNRIQIDPVKLSSGYK DVILWFSFGASCFILLAIAMGLVFICVKNGNMRCTIC I | 212 |
| | AEK84765 A/spot-billed duck/Korea/447/ 2011 2011/04/ HA 341610318 | LVFALVAIIPTNADKICLGHHAVSNGTKVNTLTERGV EVVNATETVERTNVPRICSKGKRTVDLGQCGLLGTIT GPPQCDQFLEFSADLIIERREGSDVCYPGKFVNEEAL RQILRESGGIDKETMGFTYSGIRTNGATSACRRSGSS FYAEMKWLLSNTDNAAFPQMTKSYKNTRRDPALIVWG IHHSGSTTEQTKLYGSGSKLITVGSSNYQQSFVPSPG ARPQVNGQSGRIDFHWLILNPNDTVTFSFNGAFIAPD RASFLRGKSMGIQSGVQVDASCEGDCYHSGGTIISNL PFQNINSRAVGKCPRYVKQESLMLATGMKNVPEPPKG RGLFGAIAGFIENGWEGLIDGWYGFRHQNAQGEGTAA DYKSTQSAIDQITGKLNRLIEKTNQQFELIDNEFTEV EKQIGNVINWTRDSMTEVWSYNAELLVAMENQHTIDL ADSEMNKLYERVRRQLRENAEEDGTGCFEIFHKCDDD CMARIRNNTYDHSKYREEAMQNRIQIDPVKLSSGYKD VILWFSFGASCFILLAIAMGLVFICVKNGNMRCTICI | 213 |
| | AEM98291 A/wild duck/Mongolia/ 1-241/2008 2008/04/ HA 344196120 | SILVFALVAIIPTNADKICLGHHAVSNGTKVNTLTER GVEVVNATETVERTNVPRICSKGKRTVDLGQCGLLGT ITGPPQCDQFLEFSADLIIERREGSDVCYPGKFVNEE ALRQILRESGGIDKETMGFTYSGIRTNGATSACRRSG SSFYAEMKWLLSNTDNAAFPQMTKSYKNIRKDPALII WGIHHSGSTTEQTKLYGSGSKLITVGSSNYQQSFVPS PGARPQVNGQSGRIDFHWLMLNPNDTVTFSFNGAFIA PDRASFLRGKSMGIQSGVQVDANCEGDCYHSGGSIIS NLPFQNINSRAVGKCPRYVKQESLMLATGMKNVPELP KGRGLFGAIAGFIENGWEGLIDGWYGFRHQNAQGEGT AADYKSTQSAIDQITGKLNRLIEKTNQQFELIDNEFT EVEKQIGNVINWTRDSMTEVWSYNAELLVAMENQHTI DLADSEMNKLYERVKRQLRENAEEDGTGCFEIFHKCD DDCMASIRNNTYDHSKYREEAMQNRIQINPVKLSSGY KDVILWFSFGASCFILLAIAMGLVFICVKNGNMRCTI | 214 |
| | AFM09439 A/emperor goose/Alaska/ 44063-061/2006 2006/05/23 HA 390535062 | QILAFIACMLIGAKGDKICLGHHAVANGTKVNTLTER GIEVVNATETVETVNIKKICTQGKRPTDLGQCGLLGT LIGPPQCDQFLEFDADLIIERRKGTDVCYPGKFTNEE SLRQILRGSGGIDKESMGFTYSGIRTNGATSACRRSG SSFYAEMKWLLSNSDNAAFPQMTKSYRNPRNKPALII WGVHHSGSATEQTKLYGSGNKLITVGSSKYQQSFVPS PGARPQVNGQSGRIDFHWLLLDPNDTVTPTFNGAFIA PERASFFRGESLGVQSDVPLDSGCEGDCFHSGGTIVS SLPFQNINPRTVGKCPRYVKQTSLLLATGMRNVPENP KTRGLFGAIAGFIENGWEGLIDGWYGFRHQNAQGEGT AADYKSTQSAIDQITGKLNRLIDKTNQQFELIDNEFS EIEQQIGNVINWTRDSMTEVWSYNAELLVAMENQHTI DLADSEMNKLYERVRKQLRENAEEDGTGCFEIFHKCD DQCMESIRNNTYDHTQYRTESLQNRIQINPVKLSSGY KDIILWFSFGASCFLLLAIAMGLVFICIKNGNMRCTI CI | 215 |
| | AFV33945 A/guinea fowl/Nebraska/ 17096-1/2011 2011/04/05 HA 409676820 | MNTQILALIACMLIGAKGDKICLGHHAVANGTKVNTL TERRIEVVNATETVETANIKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSNNAAFPQMTKSYRNPRNKPA LIVWGVHHSGSATEQTKLYGSGSKLITVGSSKYQQSF TPSPGARPQVNGQSGRIDFHWLLLDPNDTVTFTFNGA FIAPDRASFFRGESLGVQSDVPLDSGCEGDCFHKGGT | 216 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEIWSYNAELLVAMENQ HTIDLADSEMNKLYERVRKQLRENAEEDGTGCFEIFH KCDDQCMESIRNNTYDHTQYRAESLQNRIQIDPVKLS SGYKDIILWFSFGASCFLLLAIAMGLVFICIKNGNMR CTICI | |
| AFV33947 A/goose/ Nebraska/17097-4/2011 2011/04/05 HA 409676827 | MNTQILALIACMLIGAKGDKICLGHHAVANGTKVNTL TERGIEVVNATETVETANIKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSDNAAFPQMTKSYRNPRNKPA LIVWGVHHSASATEQTKLYGSGSKLITVGSSKYQQSF TPSPGARPQVNGQSGRIDFHWLLLDPNDTVTFTFNGA FIAPDRASFFRGESLGVQSDVPLDSGCEGDCFHKGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEIWSYNAELLVAMENQ HTIDLADSEMNKLYERVRKQLRENAEEDGTGCFEIFH KCDDQCMESIRNNTYDHTQYRAESLQNRIQIDPVKLS SGYKDIILWFSFGASCFLLLAIAMGLVFICIKNGNMR CTICI | 217 |
| AFX85260 A/ruddy turnstone/ Delaware Bay/220/1995 1995/05/21 HA 423514912 | MNTQILAFIACMLIGINGDKICLGHHAVANGTKVNTL TERGIEVVNATETVETANIKRICTQGKRPIDLGQCGL LGTLIGPPQCDQFLEFDSDLIIERREGTDVCYPGKFT NEESLRQILRGSGGIDKESMGFTYSGIRTNGATSACI RLGSSFYAEMKWLLSNSDNAAFPQMTKSYRNPRNKPA LIIWGVHHSGSANEQTKLYGSGNKLITVGSSKYQQSF TPSPGARPQVNGQSGRIDFHWLLLDPNDTVTFTFNGA FIAPDRASFFRGESLGVQSDVPLDSSCGGDCFHSGGT IVSSLPFQNINPRTVGRCPRYVKQTSLLLATGMKNVP ENPKTRGLFGAIAGFIENGWEGLIDGWYGFRHQNAQG EGTAADYKSTQSAIDQITGKLNRLIDKTNQQFELIDN EFNEIEQQIGNVINWTRDSMTEVWSYNAELLVAMENQ HTIDLADSEMNKLYERVRKQLRENAEEDGTGCFEIFH KCDDQCMESIRNNTYDHTQYRTESLQNRIQIDPVKLS SGYKDIILWFSFGASCFLLLAIAMGLVFICIKNGNMR CTICI | 218 |
| AGE08098 A/northern shoverl/ Mississippi/ 11OS145/2011 2011/01/08 HA 444344488 | MNTQILTLIACMLIGAKGDKICLGHHAVANGTKVNTL TERGIEVVNATETVETANIKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSDNAAFPQMTKSYRNPRNKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHNGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRAESLQNRIQIDPVKLS SGYKDIILWFSFGASCFLLLAIAMGLVFICIKNGNMR CTICI | 219 |
| AGI60301 A/Hangzhou/1/ 2013 2013/03/24 HA 475662454 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGISGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH | 220 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | KCDDDCMASIRNNTYDHSKYREEAMQNRIQIDPVKLS SGYKDVILWFSFGASCFILLAIVMGLVFICVKNGNMR CTICI | |
| | AGI60292 A/Shanghai/ 4664T/2013 2013/03/05 HA 476403560 | MNTQILVFALIAIIPANADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCHHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 221 |
| | AGJ72861 A/chicken/ Zhejiang/DTID- ZJU01/2013 2013/04/ HA 479280294 | MNTQILVFALIAIIPTNADKICLGHHAVSNGTKVNTL TERGGEVVNATETVERTNIPRICSKGKKTVDLGQGGP RGTITGPPQCDQFLEFSADLIMERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGQSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 222 |
| | AGJ73503 A/Nanjing/1/ 2013 2013/03/28 HA 479285761 | MNTQILVFALIAIIPTNADKICLGHHAVSNGTKVNTL TERGVEVVNATETVERTNIPRICSKGKMTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 223 |
| | BAN16711 A/duck/Gunma/ 466/2011 2011// HA 482661571 | MNIQVLVFALMAIIPTNADKICLGHHAVSNGTKVNTL TERGVEVVNATETVERTNVPRICSKGKRTVDLGQCGL LGTITGPPQCDQFLEFSADLIIERREGSDVCYPGKFV NEEALRQILRESGGIDKETMGFTYSGIRINGITSACR RSGSSFYAEMKWLLSNTDNAAFPQMTKSYKNTRRDPA LIAWGIHHSGSTTEQTKLYGSGSKLITVGSSNYQQSF VPSPGARPQVNGQSGRIDFHWLILNPNDTVTFSFNGA FIAPDRASFLRGKSMGIQSGVQVDASCEGDCYHSGGT IISNLPFQNINSRAVGKCPRYVKQESLMLATGMKNVP ELPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVRRQLRENAEEDDTGCFEIFH KCDDDCMASIRNNTYDHSKYREEAMQNRIQIDPVKLS SGYKDVILWFSFGASCFILLAIAMGLVFICVKNGNMR CTICI | 224 |
| | AGK84857 A/Hangzhou/2/ | MNTQILVFALIAIIPTNADKICLGHHAVSNGTKVNTL TERGVEVVNATETVERTNIPRICSKGKRTVDLGQCGL | 225 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | 2013 2013/04/01 HA 485649824 | LGTITGPPQCDQFLEFSADLIIERREGSDVCYPGKFV NEEALRQILRESGGIDKEAMGFTYSGIRTNGATSACR RSGSSFYAEMKWLLSNTDNAAFPQIIKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AGL44438 A/Shanghai/02/ 2013 2013/03/05 HA 496493389 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 226 |
| | AGL33692 A/Shanghai/ 4655T/2013 2013/02/26 HA 491874175 | GMIDGWYGFRHQNAQGEGTAADYKSTQSAIDQITGKL NRLIEKTNQQFELIDNEFTEVEKQIGNVINWTRDSIT EVWSYNAELLVAMENQHTIDLADSEMDKLYERVKRQL RENAEEDGTGCFEIFHKCDDDCMASIRNNTYDHSKYR EEAMQNRIQIDPVKLSSGYKDVILWFSFGASCFILLA IAMGLVFICVKNGNMRCTICI | 227 |
| | AGL33693 A/Shanghai/ 4659T/2013 2013/02/27 HA 491874186 | GMIDGWYGFRHQNAQGEGTAADYKSTQSAIDQITGKL NRLIEKTNQQFELIDNEFNEVEKQIGNVINWTRDSIT EVWSYNAELLVAMENQHTIDLADSEMDKLYERVKRQL RENAEEDGTGCFEIFHKCDDDCMASIRNNTYDHSKYR EEAMQNRIQIDPVKLSSGYKDVILWFSFGASCFILLA IVMGLVFICVKNGNMRCTICI | 228 |
| | AGL95088 A/Taiwan/ S02076/2013 2013/04/22 HA 501485301 | VFALIAIIPTNADKICLGHHAVSNGTKVNTLTERGVE VVNATETVERTNIPRICSKGKRTVDLGQCGLLGTITG PPQCDQFLEFSADLIIERREGSDVCYPGKFVNEEALR QILRESGGIDKEAMGFTYSGIRTNGATSACRRSGSSF YAEMKWLLSNTDNAAFPQMTKSYKNTRKSPALIVWGI HHSVSTAEQTKLYGSGNKLVTVGSSNYQQSFVPSPGA RPQVNGLSGRIDFHWLMLNPNDTVTFSFNGAFIAPDR ASFLRGKSMGIQSGVQVDANCEGDCYHSGGTIISNLP FQNIDSRAVGKCPRYVKQRSLLLATGMKNVPEIPKGR GLFGAIAGFIENGWEGLIDGWYGFRHQNAQGEGTAAD YKSTQSAIDQITGKLNRLIEKTNQQFELIDNEFNEVE KQIGNVINWTRDSITEVWSYNAELLVAMENQHTIDLA DSEMDKLYERVKRQLRENAEEDGTGCFEIFHKCDDDC MASIRNNTYDHSKYREEAMQNRIQIDPVKLSSGYKDV ILWFSFGASCFILLAIVMGLVFICVKNGNMR | 229 |
| | AGL95098 A/Taiwan/ T02081/2013 2013/04/22 HA 501485319 | LVFALIAIIPTNADKICLGHHAVSNGTKVNTLTERGV EVVNATETVERTNIPRICSKGKRTVDLGQCGLLGTIT GPPQCDQFLEFSADLIIERREGSDVCYPGKFVNEEAL RQILRESGGIDKEAMGFTYSGIRTNGATSACRRSGSS FYAEMKWLLSNTDNAAFPQMTKSYKNTRKSPALIVWG IHHSVSTAEQTKLYGSGNKLVTVGSSNYQQSFVPSPG ARPQVNGLSGRIDFHWLMLNPNDTVTFSFNGAFIAPD RASFLRGKSMGIQSGVQVDANCEGDCYHSGGTIISNL PFQNIDSRAVGKCPRYVKQRSLLLATGMKNVPEIPKG RGLFGAIAGFIENGWEGLIDGWYGFRHQNAQGEGTAA DYKSTQSAIDQITGKLNRLIEKTNQQFELIDNEFNEV EKQIGNVINWTRDSITEVWSYNAELLVAMENQHTIDL ADSEMDKLYERVKRQLRENAEEDGTGCFEIFHKCDDD | 230 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | CMASIRNNTYDHSKYREEAMQNRIQIDPVKLSSGYKD VILWFSFGASCFILLAIVMGLVFICVKNGNMRCT | |
| | AGM53883 A/Shanghai/ 5083T/2013 2013/04/20 HA 507593986 | GFRHQNAQGEGTAADYKSTQSAIDQITGKLNRLIEKT NQQFELIDNEFNEVEKQIGNVINWTRDSITEVWSYNA ELLVAMENQHTIDLADSEMDKLYERVKRQLRENAEED GTGCFEIFHKCDDDCMASIRNNTYDHSKYREEAMQNR IQIDPVKLSSGYKDVILWFSFGASCFILLAIVMGLVF ICVKNGNMRCT | 231 |
| | AGM53884 A/Shanghai/ 5180T/2013 2013/04/23 HA 507593988 | AQGEGTAADYKSTQSAIDQITGKLNRLIEKTNQQFEL IDNEFNEVEKQIGNVINWTRDSITEVWSYNAELLVAM ENQHTIDLADSEMDKLYERVKRQLRENAEEDGTGCFE IFHKCDDDCMASIRNNTYDHSKYREEAMQNRIQIDPV KLSSGYKDVILWFSFGASCFILLAIVMGLVFICVKNG NMRCTICI | 232 |
| | AGM53885 A/Shanghai/ 5240T/2013 2013/04/25 HA 507593990 | QNAQGEGTAADYKSTQSAIDQITGKLNRLIEKTNQQF ELIDNEFNEVEKQIGNVINWTRDSITEVWSYNAELLV AMENQHTIDLADSEMDKLYERVKRQLRENAEEDGTGC FEIFHKCDDDCMASIRNNTYDHSKYREEAMQNRIQID PVKLSSGYKDVILWFSFGASCFILLAIVMGLVFICVK NGNMRCT | 233 |
| | AGM53886 A/Shanghai/ 4842T/2013 2013/04/13 HA 507593992 | NAQGEGTAADYKSTQSAIDQITGKLNRLIEKTNQQFE LIDNEFNEVEKQIGNVINWTRDSITEVWSYNAELLVA MENQHTIDLADSEMDKLYERVKRQLRENAEEDGTGCF EIFHKCDDDCMASIRNNTYDHSKYREEAMQNRIQIDP VKLSSGYKDVILWFSFGASCFILLAIVMGLVFICVKN GNMRCT | 234 |
| | AGM53887 A/Shanghai/ 4701T/2013 2013/04/06 HA 507593994 | NAQGEGTAADYKSTQSAIDQITGKLNRLIEKTNQQFE LIDNEFNEVEKQIGNVINWTRDSITEVWSYNAELLVA MENQHTIDLADSEMDKLYERVKRQLRENAEEDGTGCF EIFHKCDDDCMASIRNNTYDHSKYREEAMQNRIQIDP VKLSSGYKDVILWFSFGASCFILLAIVMGLVFICVKN GNMRCTIC | 235 |
| | AGN69462 A/Wuxi/2/2013 2013/03/31 HA 511105778 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEEALRQILRESGGIDKEAMGFTYSGIRTNGSTSACR RSGSSFYAEMKWLLSNTDNAAFPQMTKSYKNTRKSPA LIVWGIHHSVSTAEQTKLYGSGSKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 236 |
| | AGN69474 A/Wuxi/1/2013 2013/03/31 HA 511105798 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLINGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 236 |
| | AGO51387 A/Jiangsu/2/ 2013 2013/04/20 | MNTQILVFALIAIIPTNADKICLGHHAVSNGTKVNTL TERGVEVVNATETVERTNIPRICSKGKMTVDLGQCGL LGTITGPPQCDQFLEFSADLIIERREGSDVCYPGKFV | 238 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| HA 514390990 | NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYRXEAMXBXIQIDPVKLS SGYKDVXJWFSFGASCFILLAIVMGLVFICVKNGNMR CTICI | |
| BAN59726 A/duck/Mongolia/ 147/2008 2008/08/29 HA 519661951 | MNTQILVFALVAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIGKETMGFTYSGIRTNGATSACR RSRSSFYAEMKWLLSNTDNAAFPQMTRSYKNTRKDPA LIIWGIHHSGSTTEQTKLYGSGNKLITVGSSNYQQSF VPSPGARPQVNGQSGRIDFHWLMLNPNDTVTFSFNGA FIAPDRASFLRGKSMGIQSGVQVDANCEGDCYHNGGT IISNLPFQNINSRTVGKCPRYVKQESLLLATGMKNVP EIPKGRGLFGAIAGFIENGWEGLIDGWYGFRHQNAQG EGTAADYKSTQSAIDQITGKLNRLIERTNQQFELIDN EFTEVEKQIGNVINWTRDSMTEVWSYNAELLVAMENQ HTIDLADSEMNKLYERVKRQLRENAEEDGTGCFEIFH KCDDDCMASIRNNTYDHSKYREEAMQNRIQIDPVKLS NGYKDVILWFSFGASCFILLAIAMGLVFICVKNGNMR CTICI | 239 |
| BAN59727 A/duck/Mongolia/ 129/2010 2010// HA 519661954 | MNTQILVFALVAIIPTNADKICLGHHAVSNGTKVNTL TERGVEVVNATETVERTNVPRICSKGKRTVDLGQCGL LGTITGPPQCDQFLEFSADLIIERREGSDVCYPGKFV NEEALRQILRESGGIDKETMGFTYSGIRTNGATSACR RSGSSFYAEMKWLLSNTDNAAFPQMTKSYKNTRKDPA LIIWGIHHSGSTTEQTKLYGSGSKLITVGSSNYQQSF VPSPGARPQVNGQSGRIDFHWLMLNPNDTVTFSFNGA FIAPDRASFLRGKSMGIQSGVQVDASCEGDCYHSGGT IISNLPFQNINSRAVGKCPRYVKQESLMLATGMKNVP ELPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVKRQLRENAEEDGTGCFEIFH KCDDDCMASIRNNTYDHSKYREEAMQNRIQINPVKLS SGYKDVILWFSFGASCFILLAIAMGLVFICVKNGNMR CTICI | 240 |
| AGQ80952 A/duck/Jiangxi/ 3096/2009 2009// HA 523788794 | MNTQILVFALVAIIPTNADKICLGHHAVSNGTKVNTL TERGVEVVNATETVERTSIPRICSKGKRAVDLGQCGL LGTITGPPQCDQFLEFSADLIIERREGSDVCYPGKFV NEEALRQILRESGGIDKETMGFTYSGIRTNGATSACR RSGSSFYAEMKWLLSNTDNAAFPQTTKSYKNTRKDPA LIIWGIHHSGSTTEQTKLYGSGNKLITVGSSNYQQSF VPSPGARPQVNGQSGRIDFHWLMLNPNDTVTFSFNGA FIAPDRASFLRGKSMGIQSGVQVDANCEGDCYHNGGT IISNLPFQNINSRAVGKCPRYVKQESLLLATGMKNVP EIPKGRGLFGAIAGFIENGWEGLIDGWYGFRHQNAQG EGTAADYKSTQSAIDQITGKLNRLIEKTNQQFELIDN EFTEVERQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVKLS SGYKDVILWFSFGASCFILLAIAMGLVFICVKNGNMR CTICI | 241 |
| AGQ80989 A/duck/Jiangxi/ 3257/2009 2009// HA 523788868 | MNTQILVFALVAIIPTNADKICLGHHAVSNGTKVNTL TERGVEVVNATETVERTSIPRICSKGKRAVDLGQCGL LGTITGPPQCDQFLEFSADLIIERREGSDVCYPGKFV NEEALRQILRESGGIDKETMGFTYSGIRTNGATSACR RSGSSFYAEMKWLLSNTDNAAFPQTTKSYKNTRKDPA LIIWGIHHSGSTTEQTKLYGSGNKLITVGXSNYQQSF VPSPGARPQVNGQSGRIDFHWLMLNPNDTVTFSFNGA FIAPDRASFLRGKSMGIQSGVQVDANCEGDCYHNGGT IISNLPFQNINSRAVGKCPRYVKQESLLLATGMKNVP EIPKGRGLFGAIAGFIENGWEGLIDGWYGFRHQNAQG | 242 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | EGTAADYKSTQSAIDQITGKLNRLIEKTNQQFELIDN EFTEVERQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVKLS SGYKDVILWFSFGASCFILLAIAMGLVFICVKNGNMR CTICI | |
| AGQ81043 A/chicken/ Rizhao/515/2013 2013// HA 523788976 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEEMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 243 |
| AGR33894 A/chicken/ Rizhao/719b/2013 2013// HA 524845213 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDRSKYREEAMQNRXXXXXXXXX XXXKDVILWFSFGASCFILLAIVMGLVFICVKNGNMR CTICI | 244 |
| AGR49399 A/chicken/ Jiangxi/ SD001/2013 2013/05/03 HA 525338528 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 245 |
| AGR49495 A/chicken/ Shanghai/ S1358/2013 2013/04/03 HA 525338689 | MNTQILVFALIAIIPTNADKICLGHHAVSNGTKVNTL TERGVEVVNATETVERTNIPRICSKGKMTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIKNNTYDHSKYREEAMQNRIQIDPVKLS SGYKDVILWFSFGASCFILLAIVMGLVFICVKNGNMR CTICI | 246 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | AGR49506 A/chicken/ Shanghai/S1410/ 2013 2013/04/03 HA 525338708 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGQSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 247 |
| | AGR49554 A/chicken/ Zhejiang/SD033/ 2013 2013/04/11 HA 525338789 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVRRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 248 |
| | AGR49566 A/duck/Anhui/ SC702/2013 2013/04/16 HA 525338809 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDNRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 249 |
| | AGR49722 A/homing pigeon/Jiangsu/ SD184/2013 2013/04/20 HA 525339071 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSEIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGQSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 250 |
| | AGR49734 A/pigeon/Shanghai/ S1069/2013 2013/04/02 HA 525339091 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTITFSFNGA | 251 |

TABLE 15-continued

H10 Hemagglutinin Amino Acid Sequences

| SEQ ID NO: Accession No/Strain/Protein | Amino Acid Sequence | SEQ ID NO: |
|---|---|---|
| | FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| AGR49770 A/wild pigeon/Jiangsu/ SD001/2013 2013/04/17 HA 525339151 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGQSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 252 |
| AGY41893 A/Huizhou/01/ 2013 2013/08/08 HA 552049496 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 253 |
| AGY42258 A/mallard/ Sweden/91/2002 2002/12/12 HA 552052155 | FALVAIIPTNADKICLGHHAVSNGTKVNTLTERGVEV VNATETVERTNVPRICSRGKRTVDLGQCGLLGTIXGP PQCDQFLEFSADLIIERREGSDVCYPGKFVNEEALRQ ILRESGGIDKETMGFTYSGIRTNGAXSACRRSGSSFY AEMKWLLSNTDNAAFPQMTKSYKNTRNDPALIIWGIH HSGSTTEQTKLYGSGNKLITVGSSNYQQSFVPSPGAR PQVNGQSGRIDFHWLILNPNDTVTFSFNGAFIAPDRA SFLRGKSMGIQSGVQIDANCEGDCYHSGGTIISNLPF QNINSRAVGKCPRYVKQESLLLATGMKNVPEIPKGRG LFGAIAGFIENGWEGLIDGWYGFRHQNAQGEGTAADY KSTQSAIDQITGKLNRLIEKTNQQFELIDNEFTEVEK QIGNVINWTRDSMTEVWSYNAELLVAMENQHTIDLAD SEMNKLYERVRRQLRENAEEDGTGCFEIFHKCDDDCM ASIRNNTYDHSKYREEAMQNRIQIDPVKLSSGYKDVI LWFSFGASCFILLAIAMGLVFMCVKNGNMRCTICI | 254 |
| AHA11441 A/guinea fowl/Nebraska/ 17096/2011 2011/04/10 HA 557478572 | MNTQILALIACMLIGAKGDKICLGHHAVANGTKVNTL TERGIEVVNATETVETANIKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSNNAAFPQMTKSYRNPRNKPA LIVWGVHHSGSATEQTKLYGSGSKLITVGSSKYQQSF TPSPGARPQVNGQSGRIDFHWLLLDPNDTVTFTFNGA FIAPDRASFFRGESLGVQSDVPLDSGCEGDCFHKGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEIWSYNAELLVAMENQ HTIDLADSEMNKLYERVRKQLRENAEEDGTGCFEIFH KCDDQCMESIRNNTYDHTQYRAESLQNRIQIDPVKLS | 255 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | SGYKDIILWFSFGASCFLLLAIAMGLVFICIKNGNMR CTICI | |
| AHA11452 A/turkey/Minnesota/ 32710/2011 2011/07/12 HA 557478591 | MNTQILALIACMLVGIKGDKICLGHHAVANGTKVNTL TERGIEVVNATETVETANIKKICTQGKRPTDLGQCGL LGTLIGPPQCDQFLEFDADLIIERREGTDVCYPGKFT NEEPLRQILRGSGGIDKESMGFTYSGIRTNGATSTCR RSGSSFYAEMKWLLSNSNNAAFPQMTKSYRNPRNKPA LIVWGVHHSGSATEQTKLYGSGSKLITVGSSKYQQSF TPSPGARPQVNGQSGRIDFHWLLLDPNDTVTFTFNGA FIAPDRASFFRGESLGVQSDVPLDSGCEGDCFHKGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFEMIDN EFSEIEQQIGNVINWTRDSMTEIWSYNAELLVAMENQ HTIDLADSEMNKLYERVRKQLRENAEEDGTGCFEIFH KCDDQCMESIRNNTYDHTQYRAESLQNRIQIDPVKLS SGYKDIILWFSFGASCFLLLAIAMGLVFICIKNGNMR CTICI | 256 |
| AHA11461 A/turkey/Minnesota/ 31900/2011 2011/07/05 HA 557478606 | MNTQILALIACMLVGIKGDKICLGHHAVANGTKVNTL TERGIEVVNATETVETANIKKICTQGKRPTDLGQCGL LGTLIGPPQCDQFLEFDADLIIERREGTDVCYPGKFT NEEPLRQILRGSGGIDKESMGFTYSGIRTNGATSTCR RSGSSFYAEMKWLLSNSNNAAFPQMTKSYRNPRNKPA LIVWGVHHSGSATEQTKLYGSGSKLITVGSSKYQQSF TPSPGARPQVNGQSGRIDFHWLLLDPNDTVTFTFNGA FIAPDRASFFRGESLGVQSDVPLDSGCEGDCFHKGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTEIWSYNAELLVAMENQ HTIDLADSEMNKLYERVRKQLRENAEEDGTGCFEIFH KCDDQCMESIRNNTYDHTQYRAESLQNRIQIDPVKLS SGYKDIILWFSFGASCFLLLAIAMGLVFICIKNGNMR CTICI | 257 |
| AHK10585 A/chicken/ Guangdong/G1/2013 2013/05/05 HA 587680636 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSKCR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 258 |
| AGG53366 A/wild duck/Korea/ CSM42-34/2011 2011/03/ HA 459252887 | MNTQILVFALVAIIPTNADKICLGHHAVSNGTKVNTL TERGVEVVNATETVERTNVPRICSKGKRTVDLGQCGL LGTITGPPQCDQFLEFSADLIIERREGSDVCYPGKFV NEEALRQILRESGGIDKETMGLTYSGIRTNGATSACR RSGSSFYAEMKWLLSNTDNAAFPQMTKSYKNTRRDPA LIVWGIHHSGSSTEQTKLYGSGSKLITVGSSNYQQSF VPSPGARPQVNGQSGRIDFHWLILNPNDTVTFSFNGA FIAPDRASFLRGKSMGIQSGVQVDASCEGDCYHSGGT IISNLPFQNINSRAVGKCPRYVKQESLMLATGMKNVP ELPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVRLS SGYKDVILWFSFGASCFILLAIAMGLVFICVKNGNMR CTICI | 259 |
| AGG53377 A/wild duck/Korea/ CSM42-1/2011 | MNTQILVFALVAIIPTNADKICLGHHAVSNGTKVNTL TERGVEVVNATETVERTNVPRICSKGKRTVDLGQCGL LGTITGPPQCDQFLEFSADLIIERREGSDVCYPGKFV NEEALRQILRESGGIDKETMGLTYSGIRTNGATSACR | 260 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | 2011/03/<br>HA 459252925 | RSGSSFYAEMKWLLSNTDNAAFPQMTKSYKNTRRDPA<br>LIVWGIHHSGSSTEQTKLYGSGSKLITVGSSNYQQSF<br>VPSPGARPQVNGQSGRIDFHWLILNPNDTVTFSFNGA<br>FIAPDRASFLRGKSMGIQSGVQVDASCEGDCYHSGGT<br>IISNLPFQNINSRAVGKCPRYVKQESLMLATGMKNVP<br>ELPKGRGLFGAIAGFIENGWEGLIDGWYGFRHQNAQG<br>EGTAADYKSTQSAIDQITGKLNRLIEKTNQQFELIDN<br>EFTEVEKQIGNVINWTRDSMTEVWSYNAELLVAMENQ<br>HTIDLADSEMNKLYERVRRQLRENAEEDGTGCFEIFH<br>KCDDDCMASIRNNTYDHSKYREEAMQNRIQIDPVRLS<br>SGYKDVILWFSFGASCFILLAIAMGLVFICVKNGNMR<br>CT | |
| | AGG53399<br>A/wild<br>duck/Korea/<br>MHC39-26/2011<br>2011/03/<br>HA 459253005 | MNTQILVFALVAIIPTNADKICLGHHAVSNGTKVNTL<br>TERGVEVVNATETVERTNVPRICSKGKRTVDLGQCGL<br>LGTITGPPQCDQFLEFSADLIIERREGSDVCYPGKFV<br>NEEALRQILRESGGIDKETMGFTYSGIRTNGATSACR<br>RSGSSFYAEMKWLLSNTDNAAFPQMTKSYKNTRRDPA<br>LIVWGIHHSGSTTEQTKLYGSGSKLITVGSSNYQQSF<br>VPSPGARPQVNGQSGRIDFHWLILNPNDTVTFSFNGA<br>FIAPDRASFLRGKSMGIQSGVQVDASCEGDCYHSGGT<br>IISNLPFQNINSRAVGKCPRYVKQESLMLATGMKNVP<br>EPPKGRGLFGAIAGFIENGWEGLIDGWYGFRHQNAQG<br>EGTAADYKSTQSAIDQITGKLNRLIEKTNQQFELIDN<br>EFTEVEKQIGNVINWTRDSMTEVWSYNAELLVAMENQ<br>HTIDLADSEMNKLYERVRRQLRENAEEDGTGCFEIFH<br>KCDDDCMASIRNNTYDHSKYREEAMQNRIQIDPVKLS<br>SGYKDVILWFSFGASCFILLAIAMGLVFICVKNGNMR<br>CTICI | 261 |
| | AGG53432<br>A/wild<br>duck/Korea/<br>MHC35-41/2011<br>2011/03/<br>HA 459253136 | MNTQILVFALVAIIPTNADKICLGHHAVSNGTKVNTL<br>TERGVEVVNATETVERTNVPRICSKGKRTVDLGQCGL<br>LGTITGPPQCDQFLEFSADLIIERREGSDVCYPGKFV<br>NEEALRQILRESGGIDKETMGFTYSGIRTNGATSACR<br>RSGSSFYAEMKWLLSNTDNAAFPQMTKSYKNTRRDPA<br>LIVWGIHHSGSTTEQTKLYGSGSKLITVGSSNYQQSF<br>VPSPGARPQVNGQSGRIDFHWLILNPNDTVTFSFNGA<br>FIAPDRASFLRGKSMGIQSGVQVDASCEGDCYHSGGT<br>IISNLPFQNINSRAVGKCPRYVKQESLMLATGMKNVP<br>EPPKGRGLFGAIAGFIENGWEGLIDGWYGFRHQNAQG<br>EGTAADYKSTQSAIDQITGKLNRLIEKTNQQFELIDN<br>EFTEVEKQIGNVINWTRDSMTEVWSYNAELLVAMENQ<br>HTIDLADSEMNKLYERVRRQLRENAEEDGTGCFEIFH<br>KCDDDCMASIRNNTYDHSKYREEAMQNRIQIDPVKLS<br>SGYKDVILWFSFGASCFILLAIAMGLVFICVKNGNMR<br>CT | 262 |
| | AGG53476<br>A/wild<br>duck/Korea/<br>SH19-27/2010<br>2010/12/<br>HA 459253257 | MNTQILVFALVAIIPTNADKICLGHHAVSNGTKVNTL<br>TERGVEVVNATETVERTNVPRICSKGKRTVDLGQCGL<br>LGTITGPPQCDQFLEFSADLIIERREGSDVCYPGKFV<br>NEEALRQILRESGGIDKETMGFTYSGIRTNGATSACR<br>RSGSSFYAEMKWLLSNTDNAAFPQMTKSYKNTRRDPA<br>LIVWGIHHSGSTTEQTKLYGSGSKLITVGSSNYQQSF<br>VPSPGARPQVNGQSGRIDFHWLILNPNDTVTFSFNGA<br>FIAPDRASFLRGKSMGIQSGVQVDASCEGDCYHSGGT<br>IISNLPFQNINSRAVGKCPRYVKQESLMLATGMKNVP<br>ELPKGRGLFGAIAGFIENGWEGLIDGWYGFRHQNAQG<br>EGTAADYKSTQSAIDQITGKLNRLIEKTNQQFELIDN<br>EFTEVEKQIGNVINWTRDSMTEVWSYNAELLVAMENQ<br>HTIDLADSEMNKLYERVRRQLRENAEEDGTGCFEIFH<br>KCDDDCMASIRNNTYDHSKYREEAMQNRIQIDPVKLS<br>SGYKDVILWFSFGASCFILLAIAMGLVFICVKNGNMR<br>CTI | 263 |
| | AGG53487<br>A/wild<br>duck/Korea/<br>SH19-50/2010<br>2010/01/<br>HA 459253278 | MNTQILVFALVAIIPTNADKICLGHHAVSNGTKVNTL<br>TERGVEVVNATETVERTNVPRICSKGKRTVDLGQCGL<br>LGTITGPPQCDQFLEFSADLIIERREGSDVCYPGKFV<br>NEEALRQILRESGGIDKETMGFTYSGIRTNGATSACR<br>RSGSSFYAEMKWLLSNTDNAAFPQMTKSYKNTRRDPA<br>LIVWGIHHSGSTTEQTKLYGSGSKLITVGSSNYQQSF<br>VPSPGARPQVNGQSGRIDFHWLILNPNDTVTFSFNGA<br>FIAPDRASFLRGKSMGIQSGVQVDASCEGDCYHSGGT<br>IISNLPFQNINSRAVGKCPRYVKQESLMLATGMKNVP<br>ELPKGRGLFGAIAGFIENGWEGLIDGWYGFRHQNAQG<br>EGTAADYKSTQSAIDQITGKLNRLIEKTNQQFELIDN | 264 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | EFTEVEKQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVKLS SGYKDVILWFSFGASCFILLAIAMGLVFICVKNGNMR CTICI | |
| AGG53520 A/wild duck/Korea/ SH20-27/2008 2008/12/ HA 459253409 | QILVFALVAIIPTNADKICLGHHAVSNGTKVNTLTER GVEVVNATETVERTNVPRICSKGKRTVDLGQCGLLGT ITGPPQCDQLLEFSADLIIERREGTDVCYPGKEVNEE ALRQILRESGGIEKETMGFTYSGIRTNGATSACRRSG SSFYAEMKWLLSNTDNAAFPQMTKSYKNTRKDPALII WGIHHSGSTTEQTKLYGSGSKLITVGSSNYQQSFVPS PGARPQVNGQSGRIDFHWLMLNPNDTVTFSFNGAFIA PDRASFLRGKSMGIQSGVQVDANCEGDCYHSGGTIIS NLPFQNINSRAVGKCPRYVKQESLMLATGMKNVPELP KGRGLFGAIAGFIENGWEGLIDGWYGFRHQNAQGEGT AADYKSTQSAIDQITGKLNRLIEKTNQQFELIDNEFT EVEKQIGNVINWTRDSMTEVWSYNAELLVAMENQHTI DLADSEMNKLYERVKRQLRENAEEDGTGCFEIFHKCD DDCMASIRNNTYDHSKYREEAMQNRIQINPVKLSSGY KDVILWFSFGASCFILLAIAMGLVFICVKNGNMR | 265 |
| AGL43637 A/Taiwan/1/2013 2013// HA 496297389 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGPSGRIDFHWLMLNPNDTVTFSFNGA FIAPDRASFLRGKSMGIQSGVQVDANCEGDCYHSGGT IINNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 266 |
| AGL97639 A/mallard/ Minnesota/AI09-3770/2009 2009/09/12 HA 505555371 | IACMLVGAKGDKICLGHHAVANGTKVNTLTERGIEVV NATETVETANIKKLCTQGKRPTDLGQCGLLGTLIGPP QCDQFLEFDADLIIERREGTDVCYPGKFTNEESLRQI LRGSGGIDKESMGFTYSGIRTNGATSACRRSGSSFYA EMKWLLSNSDNAAFPQMTKSYRNPRNKPALIIWGVHH SGSATEQTKLYGSGNKLITVGSSKYQQSFTPSPGARP QVNGQSGRIDFHWLLLDPNDTVIFTFNGAFIAPDRAS FFRGESLGVQSDVPLDSGCEGDCFHSGGTIVSSLPFQ NINPRTVGKCPRYVKQTSLLLATGMRNVPENPKTRGL FGAIAGFIENGWEGLIDGWYGFRHQNAQGEGTAADYK STQSAIDQITGKLNRLIDKTNQQFELIDNEFSEIEQQ IGNVINWTRDSMTELWSYNAELLVAMENQHTIDLADS EMNKLYERVRKQLRENAEEDGTGCFEIFHKCDDQCME SIRNNTYDHTQYRTESLQNRIQIDPVKLS | 267 |
| AGO02477 A/Xuzhou/1/ 2013 2013/04/25 HA 512403688 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGSKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKSRNMR CTICI | 268 |
| AGR84942 A/Suzhou/5/ 2013 2013/04/12 HA 526304561 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR | 269 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | RSGSSFYAEMKWLLSNTDNAAFPQMTKSYKNTRKSPA LIVWGIHHSVSTAEQTKLYGSGSKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| AGR84954 A/Nanjing/6/ 2013 2013/04/11 HA 526304594 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNRNMR CTICI | 270 |
| AGR84978 A/Wuxi/4/2013 2013/04/07 HA 526304656 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKSRNMR CTICI | 271 |
| AGR84990 A/Wuxi/3/2013 2013/04/07 HA 526304688 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKSRNMR CTICI | 272 |
| AGR85002 A/Zhenjiang/1/ 2013 2013/04/07 HA 526304708 | MNTQILVFALIAIIPTNADKICLGHHAVSNGTKVNTL TERGVEVVNATETVERTNIPRICSKGKMTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN | 273 |

TABLE 15-continued

H10 Hemagglutinin Amino Acid Sequences

| SEQ ID NO: Accession No/Strain/Protein | Amino Acid Sequence | SEQ ID NO: |
|---|---|---|
| | EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKSRNKR CTICI | |
| AGR85026 A/Nanjing/2/ 2013 2013/04/05 HA 526304762 | MNTQILVFALIAIIPTNADKICLGHHAVSNGTKVNTL TERGVEVVNATETVERTNIPRICSKGKMTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKSRNMR CTICI | 274 |
| AGU02230 A/Zhejiang/ DTID-ZJU05/2013 2013/04/ HA 532808765 | LVFALIAIIPTNADKICLGHHAVSNGTKVNTLTERGG EVVNATETVERTNIPRICSKGKRTVDLGQCGLRGTIT GPPQCDQFLEFSADLIIERREGSDVCYPGKFVNEEAL RQILRESGGIDKEAMGFTYSGIRTNGATSACRRSGSS FYAEMKWLLSNTDNAAFPQMTKSYKNTRKSPALIVWG IHHSVSTAEQTKLYGSGNKLVTVGSSNYQQSFVPSPG ARPQVNGLSGRIDFHWLMLNPNDTVTFSFNGAFIAPD RASFLRGKSMGIQSGVQVDANCEGDCYHSGGTIISNL PFQNIDSRAVGKCPRYVKQRSLLLATGMKNVPEIPKG RGLFGAIAGFIENGWEGLIDGWYGFRHQNAQGEGTAA DYKSTQSAIDQITGKLNRLIEKTNQQFELIDNEFNEV EKQIGNVINWTRDSITEVWSYNAELLVAMENQHTIDL ADSEMDKLYERVKRQLRENAEEDGTGCFEIFHKCDDD CMASIRNNTYDHSKYREEAMQNRIQIDPVKLSSGYKD VILWFSFGASCFILLAIVMGLVFICVKNGNMRCT | 275 |
| AGU02233 A/Zhejiang/ DTID-ZJU08/2013 2013/04/ HA 532808788 | FALIAIIPTNADKICLGHHAVSNGTKVNTLTERGGEV VNATETVERTNFPRICSKGKRTVDLGQCGLRGTITGP PQCDQFLEFSADLIIERREGSDVCYPGKFVNEEALRQ ILRESGGIDKEAMGFTYSGIRTNGATSACRRSGSSFY AEMKWLLSNTDNAAFPQMTKSYKNTRKSPALIVWGIH HSVSTAEQTKLYGSGNKLVTVGSSNYQQSFVPSPGAR PQVNGLSGRIDFHWLMLNPNDTVTFSFNGAFIAPDRA SFLRGKSMGIQSGVQVDANCEGDCYHSGGTIISNLPF QNIDSRAVGKCPRYVKQRSLLLATGMKNVPEIPKGRG LFGAIAGFIENGWEGLIDGWYGFRHQNAQGEGTAADY KSTQSAIDQITGKLNRLIEKTNQQFELIDNEFNEVEK QIGNVINWTRDSITEVWSYNAELLVAMENQHTIDLAD SEMDKLYERVKRQLRENAEEDGTGCFEIFHKCDDDCM ASIRNNTYDHSKYREEAMQNRIQIDPVKLSSGYKDVI LWFSFGASCFILLAIVMGLVFICVKNGNMRCT | 276 |
| AGW82588 A/tree sparrow/Shanghai/ 01/2013 2013/05/09 HA 546235348 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTIGI | 277 |
| AGW82600 A/Shanghai/ CN01/2013 | ALIAIIPTNADKICLGHHAVSNGTKVNTLTERGVEVV NATETVERTNIPRICSKGKRTVDLGQCGLLGTITGPP QCDQFLEFSADLIIERREGSDVCYPGKFVNEEALRQI | 278 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| 2013/04/11 HA 546235368 | LRESGGIDKEAMGFTYSGIRTNGATSACRRSRSSFYA EMKWLLSNTDNAAFPQMTKSYKNTRKSPALIVWGIHH SVSTAEQTKLYGSGNKLVTVGSSNYQQSFVPSPGARP QVNGLSGRIDFHWLMLNPNDTVTFSFNGAFIAPDRAS FLRGKSMGIQSGVQVDANCEGDCYHSGGTIMSNLPFQ NIDSRAVGKCPRYVKQRSLLLATGMKNVPEIPKGRGL FGAIAGFIENGWEGLIDWYGFRHQNAQGEGTAADYK STQSAIDQITGKLNRLIEKTNQQFELIDNEFNEVEKQ IGNVINWTRDSITEVWSYNAELLVAMENQHTIDLADS EMDKLYERVKRQLRENAEEDGTGCFEIFHKCDDDCMA SIRNNTYDHSKYREEAMQNRIQIDPVKLSSGYKDVIL WFSFGASCFILLAIVMGLVFICVKNGNMRCTICI | |
| AGW82612 A/Shanghai/ JS01/2013 2013/04/03 HA 546235388 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEEALRQILRESGGIDKEAMGFTYSGIRTNGATSACR RSGSSFYAEMKWLLSNTDNAAFPQMTKSYKNTRKNPA LIVWGIHHSGSTAEQTKLYGSGNKLVTVGSSNYQQSF APSPGARTQVNGQSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDWYGFRHQNAQG EGTAADYKSTQSAIDQITGKLNRLIEKTNQQFELIDN EFTEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIAMGLVFICVKNGNMR CTICI | 280 |
| AHA11472 A/turkey/ Minnesota/31676/ 2009 2009/12/08 HA 557478625 | MNTQILALIACMLIGAKGDKICLGHHAVANGTKVNTL TERGIEVVNATETVETANVKKICTQGKRPTDLGQCGL LGTLIGPPQCDQFLEFDADLIIERREGTDVCYPGKFT NEEESLRQILRGSGGIDKESMGFTYSGIRTNGETSACR RSGSSFYAEMKWLLSNSNNAAFPQMTKSYRNPRDKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHSGGT IVSSLPFQNINPRTVGKCPRYVKQTSLLLATGMRNVP EKPKTRGLFGAIAGFIENGWEGLIDWYGFRHQNAQG EGTAADYKSTQSAIDQITNKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRKESLQNRIQIDPVKLS SGYKDIILWFSFGASCFLLLAIAMGLVFICIKNGNMR CTICI | 281 |
| AHA11483 A/turkey/ Minnesota/14135- 2/2009 2009/08/07 HA 557478644 | MNTQILALIACMLIGAKGDKICLGHHAVANGTKVNTL TERGIEVVNATETVETANVKKICTQGKRPTDLGQCGL LGTLIGPPQCDQFLEFDADLIIERREGTDVCYPGKFT NEEESLRQILRGSGGIDKESMGFTYSGIRTNGATSACR RSGSSFYAEMKWLLSNSNNAAFPQMTKSYRNPRDKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHSGGT IVSSLPFQNINPRTVGKCPRYVKQTSLLLATGMRNVP EKPKTRGLFGAIAGFIENGWEGLIDWYGFRHQNAQG EGTAADYKSTQSAIDQITSKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRKESLQNRIQIDPVKLS SGYKDIILWFSFGASCFLLLAIAMGLVFICIKNGNMR CTICI | 282 |
| AHA11500 A/Zhejiang/ DTID-ZJU10/2013 2013/10/14 HA 557478676 | TQILVFALIAIIPTNADKICLGHHAVSNGTKVNTLTE RGVEVVNATETVERTNIPRICSKGKRTVDLGQCGLLG TITGPPQCDQFLEFSADLIIERREGSDVCYPGKFVNE EALRQILRESGGIDKEAMGFTYSGIRTNGATSACRRS GSSFYAEMKWLLSNTDNAAFPQMTKSYKNTRKSPALI VWGIHHSVSTAEQTKLYGSGNKLVTVGSSNYQQSFVP SPGARPPVNGLSGRIDFHWLMLNPNDTVTFSFNGAFI APDRASFLRGKSMGIQSGVQVDANCEGDCYHSGGTII SNLPFQNIDSRAVGKCPRYVKQRSLLLATGMKNVPEI PKGRGLFGAIAGFIENGWEGLIDWYGFRHQNAQGEG TAADYKSTQSAIDQITGKLNRLIEKTNQQFELIDNEF | 283 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | NEVEKQIGNVINWTRDSITEVWSYNAELLVAMENQHT IDLADSEMDKLYERVKRQLRENAEEDGTGCFEIFHKC DDDCMASIRNNTYDHSKYREEAMQNRIQIDPVKLSSG YKDVILWFSFGASCFILLAIVMGLVFICVKN | |
| AHA57050 A/turkey/ Minnesota/14659/ 2009 2009/08/12 HA 558484427 | MNTQILALIACMLIGAKGDKICLGHHAVANGTKVNTL TERGIEVVNATETVETANVKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSNNAAFPQMTKSYRNPRDKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHSGGT IVSSLPFQNINPRTVGKCPRYVKQTSLLLATGMRNVP EKPKTRGLFGAIAGFIENGWEGLIDGWYGFRHQNAQG EGTAADYKSTQSAIDQITSKLNRLIDKTNQQFELIDN EFSEIEQQIGNVINWTRDSMTEVWSYNAELLVAMENQ HTIDLADSEMNKLYERVRKQLRENAEEDGTGCFEIFH NCDDQCMESIRNNTYDHTQYRKESLQNRIQIDPVKLS SGYKDIILWFSFGASCFLLLAIMGLVFICIKNGNMR CTICI | 284 |
| AHA57072 A/turkey/ Minnesota/18421/ 2009 2009/09/09 HA 558484465 | MNTQILALIACMLIGAKGDKICLGHHAVANGTKVNTL TERGIEVVNATETVETANVKKICTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSNDAAFPQMTKSYRNPRDKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHSGGT IVSSLPFQNINPRTVGKCPRYVKQTSLLLATGMRNVP EKPKTRGLFGAIAGFIENGWEGLIDGWYGFRHQNAQG EGTAADYKSTQSAIDQITGKLNRLIDKTNQQFELIDN EFSEIEQQIGNVINWTRDSMTEVWSYNAELLVAMENQ HTIDLADSEMNKLYERVRKQLRENAEEDGTGCFEIFH KCDDQCMESIRNNTYDHTQYRKESLQNRIQIDPVKLS SGYKDIILWFSFGASCFLLLAIMGLVFICIKNGNMR CTICI | 285 |
| AHD25003 A/Guangdong/02/ 2013 2013/10/ HA 568260567 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNM | 286 |
| AHF20528 A/Hong Kong/470129/ 2013 2013/11/30 HA 570933555 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISSLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 287 |
| AHF20568 A/Shanghai/ CN02/2013 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV | 288 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | 2013/04/02 HA 570933626 | NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IMSNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AHH25185 A/Guangdong/ 04/2013 2013/12/16 HA 576106234 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIEKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 289 |
| | AHJ57411 A/Shanghai/PD- 01/2014 2014/01/17 HA 585478041 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VSSPGARPQVNGLSGRIDFHWLMLNPNDTVTFSFNGA FIAPDRASFLRGKSMGIQSGVQVDANCKGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 290 |
| | AHJ57418 A/Shanghai/PD- 02/2014 2014/01/17 HA 585478256 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDICYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLKGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 291 |
| | AHK10800 A/Shanghai/01/ 2014 2014/01/03 HA 587681014 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG | 292 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | | EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AHM24224 A/Beijing/3/ 2013 2013/04/16 HA 594704802 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV KEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 293 |
| | AHN96472 A/chicken/ Shanghai/PD-CN-02/2014 2014/01/21 HA 602701641 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 294 |
| | AHZ39686 A/Anhui/DEWH72-01/2013 2013// HA 632807036 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDDAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 295 |
| | AHZ39710 A/Anhui/DEWH72-03/2013 2013// HA 632807076 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTDGATSACR RSGSSFYAEMKWLLSNTDDAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 296 |

TABLE 15-continued

H10 Hemagglutinin Amino Acid Sequences

| SEQ ID NO: Accession No/Strain/Protein | Amino Acid Sequence | SEQ ID NO: |
|---|---|---|
| AHZ39746 A/Anhui/DEWH72-06/2013 2013// HA 632807136 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGERPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 297 |
| AHZ41929 A/mallard/Sweden/1621/2002 2002/12/12 HA 632810949 | MNTQILVFALVAIIPTNADKICLGHHAVSNGTKVNTL TERGVEVVNATETVERTNVPRICSRGKRTVDLGQCGL LGTITGPPQCDQFLEFSADLIIERREGSDVCYPGKFV NEEALRQILRESGGIDKETMGFTYSGIRTNGATSACR RSGSSFYAEMKWLLSNTDNAAFPQMTKSYKNTRNDPA LIIWGIHHSGSTTEQTKLYGSGNKLITVGSSNYQQSF VPSPGARPQVNGQSGRIDFHWLILNPNDTVTFSFNGA FIAPDRASFLRGKSMGIQSGVQIDANCEGDCYHSGGT IISNLPFQNINSRAVGKCPRYVKQESLLLATGMKNVP EIPKGRGLFGAIAGFIENGWEGLIDGWYGFRHQNAQG EGTAADYKSTQSAIDQITGKLNRLIEKTNQQFELIDN EFTEVEKQIGNVINWTRDSMTEVWSYNAELLVAMENQ HTIDLADSEMNKLYERVRRQLRENAEEDGTGCFEIFH KCDDDCMASIRNNTYDHSKYREEAMQNRIQIDPVKLS SGYKDVILWFSFGASCFILLAIAMGLVFMCVKNGNMR CTICI | 298 |
| AHZ42537 A/mallard/Minnesota/AI09-3770/2009 2009/09/12 HA 632811964 | MNTQILAFIACMLVGAKGDKICLGHHAVANGTKVNTL TERGIEVVNATETVETANIKKLCTQGKRPTDLGQCGL LGTLIGPPQCDQFLEFDADLIIERREGTDVCYPGKFT NEESLRQILRGSGGIDKESMGFTYSGIRTNGATSACR RSGSSFYAEMKWLLSNSDNAAFPQMTKSYRNPRNKPA LIIWGVHHSGSATEQTKLYGSGNKLITVGSSKYQQSF TPSPGARPQVNGQSGRIDFHWLLLDPNDTVTFTFNGA FIAPDRASFFRGESLGVQSDVPLDSGCEGDCFHSGGT IVSSLPFQNINPRTVGKCPRYVKQTSLLLATGMRNVP ENPKTRGLFGAIAGFIENGWEGLIDGWYGFRHQNAQG EGTAADYKSTQSAIDQITGKLNRLIDKTNQQFELIDN EFSEIEQQIGNVINWTRDSMTELWSYNAELLVAMENQ HTIDLADSEMNKLYERVRKQLRENAEEDGTGCFEIFH KCDDQCMESIRNNTYDHTQYRTESLQNRIQIDPVKLS SGYKDIILWFSFGASCFLLLAIMGLVFICIKNGNMR CTICI | 299 |
| AHZ42549 A/ruddy turnstone/Delaware/AI00-1538/2000 2000/05/20 HA 632811984 | MNTQILAFIACMLVGVRGDKICLGHHAVANGTKVNTL TEKGIEVVNATETVESANIKKICTQGKRPTDLGQCGL LGTLIGPPQCDQFLEFDSDLIIERREGTDVCYPGKFT NEESLRQILRGSGGIDKESMGFTYSGIRTNGATSACR RLGSSSFYAEMKWLLSNSDNAAFPQMTKSYRNPRNKP ALIIWGVHHSGSANEQTKLYGSGNKLITVGSSKYQQS FTPSPGARPQVNGQSGRIDFHWLLLDPNDTVIFTENG AFIAPDRASFFRGESLGIQSDVPLDSSCGGDCFHSGG TIVSSLPFQNINPRTVGKCPRYVKQTSLLLATGMRNV PENPKTRGLFGAIAGFIENGWEGLIDGWYGFRHQNAQ GEGTAADYKSTQSAIDQITGKLNRLIDKTNQQFELMD NEFNEIEQQIGNVINWTRDSMTEVWSYNAELLVAMEN QHTIDLADSEMNKLYERVKRQLRENAEEDGTGCFEIF HKCDDQCMESIRNNTYDHTQYRTESLQNRIQIDPVKL SSGYKDIILWFSFGASCFLLLAIAMGLIFICIKNGNM RCTICI | 300 |
| AID70634 A/Shanghai/Mix1/2014 2014/01/03 HA 660304650 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA | 301 |

TABLE 15-continued

H10 Hemagglutinin Amino Acid Sequences

| SEQ ID NO: Accession No/Strain/Protein | Amino Acid Sequence | SEQ ID NO: |
|---|---|---|
| | FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRIIEKTNQQFELIDN EFNEVEKQISNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| AIN76383 A/Zhejiang/ LS01/2014 2014/02/08 HA 684694637 | MNTQILVFALIAIVPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRINGITSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 302 |
| AIU46619 A/chicken/ Zhejiang/DTID- ZJU06/2013 2013/12/ HA 699978931 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVEVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 303 |
| AIU47013 A/chicken/Suzhou/ 040201H/2013 2013/04/ HA 699979673 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDMILWFSFGASCFILLAIVMGLVFICVKNGNMR CTICI | 304 |
| AJJ90490 A/chicken/ Shenzhen/742/2013 2013/12/10 HA 755178094 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRRSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS | 305 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | SGYKDVILWFSFGASCFILLAIVMGLVFICVKNGNMR CTICI | |
| AJJ90526 A/chicken/ Shenzhen/898/2013 2013/12/09 HA 755178154 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDICYPGKFV NEEALRQILRESGGIDKEAMGFTYSGIRANGATSACK RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISSLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS RGYKDVILWFSFGASCFILLAIVMGLVFICVKNGNMR CTICI | 306 |
| AJJ90538 A/silkie chicken/Shenzhen/ 918/2013 2013/12/09 HA 755178174 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 307 |
| AJJ90576 A/chicken/ Shenzhen/1665/2013 2013/12/12 HA 755178238 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDICYPGKFV NEEALRQILRESGGIDKEAMGFTYSGIRANGATSACK RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS RGYKDVILWFSFGASCFILLAIVMGLVFICVKNGNMR CTICI | 308 |
| AJJ90588 A/chicken/ Shenzhen/2110/2013 2013/12/13 HA 755178258 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRRSPA LIVWGIHHSVSTAEQTKLYGSGNKLVTVGSSNYQQSF VPSPGARPQVNGLSGRIDFHWLMLNPNDTVTFSFNGA FIAPDRASFLRGKSIGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 309 |
| AJJ90661 A/chicken/Dongguan/ 2912/2013 2013/12/18 HA | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR | 310 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | 755178380 | RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | |
| | AJJ90673 A/silkie chicken/Dongguan/ 3049/2013 2013/12/18 HA 755178400 | MNTQILVFALTAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 311 |
| | AJJ90795 A/silkie chicken/Dongguan/ 3281/2013 2013/12/18 HA 755178604 | MNTQILVFALIAIIPTNADKICLGHHAVPNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 312 |
| | AJJ90891 A/silkie chicken/Dongguan/ 3520/2013 2013/12/19 HA 755178764 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKXPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 313 |
| | AJJ90951 A/chicken/Dongguan/ 3544/2013 2013/12/19 HA 755178864 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYRNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN | 314 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| AJJ91035 A/chicken/ Shenzhen/3780/2013 2013/12/19 HA 755179004 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRRSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDNRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 315 |
| AJJ91155 A/chicken/ Dongguan/4037/2013 2013/12/19 HA 755179204 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMNKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 316 |
| AJJ92005 A/chicken/Shenzhen/ 801/2013 2013/12/09 HA 755180629 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS RGYKDVILWFSFGASCFILLAIVMGLVFICVKNGNMR CTICI | 317 |
| AJJ94254 A/chicken/ Dongguan/1374/2014 2014/02/21 HA 755184382 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 318 |

TABLE 15-continued

H10 Hemagglutinin Amino Acid Sequences

| SEQ ID NO: Accession No/Strain/Protein | Amino Acid Sequence | SEQ ID NO: |
|---|---|---|
| AJJ94606 A/chicken/ Dongguan/191/2014 2014/02/20 HA 755184968 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 319 |
| AJJ96552 A/chicken/ Jiangxi/12206/2014 2014/03/16 HA 755188219 | MNTQILVFALIAIIPTNADKICLGHHAVSNGTKVNTL TERGVEVVNATETVERTNIPRICSKGKKTIDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHNKYREEAMQNRIQIDPVKLS SGYKDVILWFSFGASCFILLAIVMGLVFICVKNGNMR CTICI | 320 |
| AJJ96684 A/chicken/ Jiangxi/13207/2014 2014/03/30 HA 755188439 | MNTQILVFALIAIIPTNADKICLGHHAVSNGTKINTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 321 |
| AJJ96732 A/chicken/Jiangxi/ 13223/2014 2014/03/30 HA 755188519 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 322 |
| AJK00354 A/duck/Zhejiang/ LS02/2014 2014/01/12 HA 755194469 | MNTQILVFALVAIIPTNADKICLGHHAVSNGTKVNTL TERGVEVVNATETVERTNIPRICSKGKKTVDLGQCGL LGTITGPPQCDQFLEFSADLIVERREGSDVCYPGKFV NEEALRQILRESGGIDKEAMGFTYSGIRTNGATSACR RSGSSFYAEMKWLLSNTDNAAFPQMTKSYKNTRKDPA LIIWGIHHSGSTTEQTKLYGSGNKLITVGSSNYQQSF | 323 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | VPSPGARPLVNGQSGRIDFHWLMLNPNDTVTFSFNGA FIAPDRASFLRGKSMGIQSGVQVDANCEGDCYHSGGT IISNLPFQNINSRAVGKCPRYVKQESLLLATGMKNVP EVPKGRGLFGAIAGFIENGWEGLIDGWYGFRHQNAQG EGTAADYKSTQSAIDQVIGKLNRLIEKTNQQFELIDH EFTEVEKQIGNVINWTRDSMTEVWSYNAELLVAMENQ HTIDLADSEMNKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | |
| AJJ91264 A/silkie chicken/Dongguan/ 4129/2013 2013/12/19 HA 755179386 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLMEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 324 |
| AJJ91314 A/chicken/ Shaoxing/2417/2013 2013/10/20 HA 755179470 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPPVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 325 |
| AJJ91402 A/chicken/Huzhou/ 4045/2013 2013/10/24 HA 755179618 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKEVILWFSFGASCFILLAIVMGLVFICVKNGNMR CTICI | 326 |
| AJJ91476 A/chicken/Huzhou/ 4076/2013 2013/10/24 HA 755179743 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRSGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSRGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH | 327 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | KCDDDCMASIRNNTYDHSKYREEAMQNRIQIDPVKLS SGYKDVILWFSFGASCFILLAIVMGLVFICVKNGNMR CTICI | |
| AJJ91725 A/chicken/Shaoxing/ 5201/2013 2013/10/28 HA 755180161 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 328 |
| AJJ91885 A/Shenzhen/ SP4/2014 2014/01/16 HA 755180429 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGVISACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS RGYKDVILWFSFGASCFILLAIVMGLVFICVKNGNMR CTICI | 329 |
| AJJ91909 A/Shenzhen/ SP26/2014 2014/01/20 HA 755180469 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDICYPGKFV NEEALRQILRESGGIDKEAMGFTYSGIRANGATSACK RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISSLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDGCMASIRNNTYDHSKYREEAMQNRIQIDPVKLS RGYKDVILWFSFGASCFILLAIVMGLVFICVKNGNMR CTICI | 330 |
| AJJ91945 A/Shenzhen/ SP38/2014 2014/01/22 HA 755180529 | MNTQILAFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIGGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 331 |
| AJJ91957 A/Shenzhen/ SP44/2014 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV | 332 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | 2014/01/23 HA 755180549 | NEEALRQILRESGGIDKEAMGFTYSGIRANGTTSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISSLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AJJ91969 A/Shenzhen/ SP48/2014 2014/01/23 HA 755180569 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 333 |
| | AJJ91993 A/chicken/ Dongguan/4119/2013 2013/12/19 HA 755180609 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLLGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFTLLAIVMGLVFICVKNGNMR CTICI | 334 |
| | AJJ92031 A/chicken/ Dongguan/4064/2013 2013/12/19 HA 755180672 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVESSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 335 |
| | AJJ92967 A/silkie chicken/Jiangxi/ 9469/2014 2014/02/16 HA 755182232 | MNTQILVFALIAIVPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRINGVISACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG | 336 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AJJ93027 A/chicken/ Jiangxi/9558/2014 2014/02/16 HA 755182332 | MNTQILVFALIAIVPTNADKICLGHHAVSNGTKVNTL TERGVEVVNATETVERTNIPRICSKGKKTVDLGQCGL LGTITGPPQCDQFLEFSADLIIERREGSDVCYPGKFV KEEALRQILRESGGIDKEAMGFTYSGIRINGVISACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 337 |
| | AJJ93051 A/chicken/ Jiangxi/10573/2014 2014/02/18 HA 755182372 | MNTQILVFALIAIVPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRINGVISACR RSGSSFYAEMKWLLSNTDDAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 338 |
| | AJJ93845 A/silkie chicken/Dongguan/ 157/2014 2014/02/20 HA 755183695 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 339 |
| | AJJ93857 A/chicken/ Dongguan/169/2014 2014/02/20 HA 755183715 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSACM RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 340 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | AJJ93869 A/chicken/ Dongguan/173/2014 2014/02/20 HA 755183735 | MNTQILVFALIAIIPTNADKICLGHHAVSNGTKVNTL TERGVEVVNATETVERTNIPRICSKGKKTVDLGQCGL LGTVTGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 341 |
| | AJJ93881 A/chicken/ Dongguan/189/2014 2014/02/20 HA 755183755 | MNTQILVFALIAIIPTNADKICLGHHAVSNGTKVNTL TERGVEVVNATETVERTNIPRICSKGKKTVDLGQCGL LGTVTGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPKYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 342 |
| | AJJ93907 A/chicken/ Dongguan/449/2014 2014/02/20 HA 755183799 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 343 |
| | AJJ93931 A/chicken/ Dongguan/536/2014 2014/02/20 HA 755183839 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISKLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 344 |
| | AJJ93943 A/chicken/ Dongguan/568/2014 2014/02/20 HA 755183859 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIEKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA | 345 |

TABLE 15-continued

H10 Hemagglutinin Amino Acid Sequences

| SEQ ID NO: Accession No/Strain/Protein | Amino Acid Sequence | SEQ ID NO: |
|---|---|---|
| | FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS GGYKDVILWFSFGASCFILLAIVMGLVFICVKNGNMR CTICI | |
| AJJ93979 A/silkie chicken/Dongguan/ 656/2014 2014/02/20 HA 755183919 | MNTQILVFALIAIIPTNADKICLGHHAVSNGTKVNTL TERGVEVVNATETVERTNIPRICSKGKKTVDLGQCGL LGTVTGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFGLIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 346 |
| AJJ94134 A/chicken/ Dongguan/1051/2014 2014/02/21 HA 755184182 | MNTQILVLALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVXLS XGYKDVILWFSFGASCFILLAIVMGLVFICVKNGNMR CTICI | 347 |
| AJJ94158 A/chicken/ Dongguan/1075/2014 2014/02/21 HA 755184222 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYRGEAMQNRIQIDPVKLS SGYKDVILWFSFGASCFILLAIVMGLVFICVKNGNMR CTICI | 348 |
| AJJ94182 A/chicken/ Dongguan/1177/2014 2014/02/21 HA 755184262 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACK RSGSSFYAEMKWLLSNTDNAAFPQMTKSYKNTRKSPA LIVWGIHHSVSIAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS | 349 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | SGYKDVILWFSFGASCFILLAIVMGLVFICVKNGNMR CTICI | |
| AJJ94194 A/silkie chicken/Dongguan/ 1264/2014 2014/02/21 HA 755184282 | MNTQILVFALIAIIPTNADKICLGHHAVSNGTKVNTL TERGVEVVNATETVERTNIPRICSKGKKTIDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQVIGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYRGEAMQNRIQIDPVKLS SGYKDVILWFSFGASCFMLLAIVMGLVFICVKNGNMR CTICI | 350 |
| AJJ94206 A/silkie chicken/Dongguan/ 1268/2014 2014/02/21 HA 755184302 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISDLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 351 |
| AJJ94344 A/silkie chicken/Dongguan/ 1451/2014 2014/02/21 HA 755184532 | MNTQILVFALIAIIPTNADKICLGHHAVSNGTKVNTL TERGVEVVNSTETVERTNIPRICSKGKKTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRTVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 352 |
| AJJ94356 A/chicken/ Dongguan/1456/2014 2014/02/21 HA 755184552 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 353 |
| AJJ94396 A/chicken/ Dongguan/1494/2014 2014/02/21 HA | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR | 354 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | 755184618 | RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP ETPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | |
| | AJJ94754 A/chicken/ Dongguan/748/2014 2014/02/20 HA 755185215 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIEKEAMGFTYSGIRANGATSACR RSGSSFYAEMKWLLSNTDNAAFPQMTKSYKNTRKSPA LIVWGIHHSVSNAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS GGYKDVILWFSFGASCFILLAIVMGLVFICVKNGNMR CTICI | 355 |
| | AJJ94838 A/chicken/ Dongguan/835/2014 2014/02/20 HA 755185356 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSASTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFGFGASCFILLAIVMGLVFICVKNGNMR CTICI | 356 |
| | AJJ94862 A/chicken/ Dongguan/843/2014 2014/02/20 HA 755185396 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIEKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS GGYKDVILWFSFGASCFILLAIVMGLVFICVKNGNMR CTICI | 357 |
| | AJJ94886 A/chicken/ Dongguan/851/2014 2014/02/20 HA 755185436 | MNTQILAFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN | 358 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | |
| | AJJ94910 A/chicken/ Dongguan/874/2014 2014/02/20 HA 755185476 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSASTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 359 |
| | AJJ94959 A/silkie chicken/Dongguan/ 967/2014 2014/02/21 HA 755185558 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACX RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 360 |
| | AJJ95048 A/chicken/ Dongguan/1009/2014 2014/02/21 HA 755185708 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP ETPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDNDCMASIRNNTYDHSKYREEAMQNRIQIDPVKLS SGYKDVILWFSFGASCFILLAIVMGLVFICVKNGNMR CTICI | 361 |
| | AJJ95171 A/chicken/ Dongguan/1314/2014 2014/02/21 HA 755185913 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVIFNFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 362 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | AJJ95227 A/chicken/ Dongguan/1382/2014 2014/02/21 HA 755186006 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDICYPGKFV NEEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 363 |
| | AJJ95251 A/chicken/ Dongguan/1401/2014 2014/02/21 HA 755186046 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYKRVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 364 |
| | AJJ95346 A/chicken/ Dongguan/1548/2014 2014/02/21 HA 755186206 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYKRVKRQLRENAEEDGTGCFEIFH KCDDDCMASIRNNTYDHNKYREEAMQNRIQIDPVKLS SGYKDVILWFSFGASCFILLAIVMGLVFICVKNGNMR CTICI | 365 |
| | AJJ95382 A/chicken/ Dongguan/1690/2014 2014/02/21 HA 755186266 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDICYPGKFV NEEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSIGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 366 |
| | AJJ95464 A/chicken/ Shenzhen/138/2014 2014/02/19 HA 755186404 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF | 367 |

TABLE 15-continued

H10 Hemagglutinin Amino Acid Sequences

| SEQ ID NO: | Accession No/Strain/Protein | Amino Acid Sequence | SEQ ID NO: |
|---|---|---|---|
| | | VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYRGEAMQNRIQIDPVKLS SGYKDVILWFSFGASCFMLLAIVMGLVFICVKNGNMR CTICI | |
| | AJJ95572 A/chicken/ Dongguan/1100/2014 2014/02/21 HA 755186584 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIEKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS GGYKDVILWFSFGASCFILLAIVMGLVFICVKNGNMR CTICI | 368 |
| | AJJ95584 A/silkie chicken/Dongguan/ 1519/2014 2014/02/21 HA 755186604 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPERASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYRGEAMQNRIQIDPVKLS SGYKDVILWFSFGASCFMLLAIVMGLVFICVKNGNMR CTICI | 369 |
| | AJJ95596 A/Shenzhen/ SP58/2014 2014/01/25 HA 755186624 | MNTQILAFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRANGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 370 |
| | AJJ95620 A/Shenzhen/ SP75/2014 2014/02/15 HA 755186664 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGSTSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH | 371 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | | KCDDDCMASIRNNTYDHSKYREEAMQNRIQIDPVKLS SGYKDVILWFSFGASCFILLAVVMGLVFICVKNGNMR CTICI | |
| | AJJ95632 A/Shenzhen/ SP62/2014 2014/02/05 HA 755186684 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNATFPQMTKSYKNTRKSPA LIIWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVETQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 372 |
| | AJJ96720 A/chicken/ Jiangxi/13220/2014 2014/03/30 HA 755188499 | MNTQILVFALIAIIPTNADKICLGHHAVSNGTKVNTL TERGVEVVNATETVERTTIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSRGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 373 |
| | AJJ96817 A/chicken/ Jiangxi/9513/2014 2014/02/16 HA 755188661 | MNTQILVFALIAIVPTNADKICLGHHAVSNGTKVNTL TERGVEVVNATEIVERTNIPRICSKGKKTVDLGQCGL LGTITGPPQCDQFLEFSADLIIERREGSDVCYPGKFV NEEALRQILRESGGIDKEAMGFTYSGIRINGVISACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 374 |
| | AJJ96841 A/Shenzhen/ SP139/2014 2014/04/02 HA 755188701 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSTCR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRACFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIEKTNQQFELIDN EFNEVERQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 375 |
| | AJJ96889 A/chicken/Jiangxi/ 13496/2014 | MNTQILVFALIAIIPTNADKICLGHHAVSNGTKVNTL TERGVEVVNATETVERTXIPRICSKGKKTVDLGQCGL LGTITGPPQCDQFLEFSADLIIERREGSDVCYPGKFV | 376 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | 2014/04/11 HA 755188781 | NEEALRQILRESGGIDKXAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSXGT IISNLPFQNIDSRAVGKCPRYVKQSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | |
| | AJJ96901 A/chicken/Jiangxi/ 13502/2014 2014/04/11 HA 755188801 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSXGT IISNLPFQNIDSRAVGKCPRYVKQSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 377 |
| | AJJ96925 A/chicken/Jiangxi/ 13513/2014 2014/04/11 HA 755188841 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYNGIRTNGATSACR RSGSSFYAEMKWLLSNTDNAAFPQMTKSYKNTRKSPA IIVWGIHHTVSTAEQTKLYGSGNKLVTVGSSNYQQSF VPSPGARPQVNGLSGRIDLHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | 378 |
| | AJJ97267 A/chicken/Jiangxi/ 13252/2014 2014/03/30 HA 755189411 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 379 |
| | AJJ97291 A/chicken/Jiangxi/ 13493/2014 2014/04/06 HA 755189451 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYNGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG | 380 |

TABLE 15-continued

H10 Hemagglutinin Amino Acid Sequences

| SEQ ID NO: Accession No/ Strain/Protein | Amino Acid Sequence | SEQ ID NO: |
|---|---|---|
| | EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | |
| AJJ97331 A/chicken/Jiangxi/ 13512/2014 2014/04/06 HA 755189517 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYNGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSIGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | 381 |
| AJJ97373 A/chicken/Jiangxi/ 13521/2014 2014/04/06 HA 755189587 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYNGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPXRASFLRGKSXGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | 382 |
| AJJ97443 A/chicken/Jiangxi/ 13530/2014 2014/04/06 HA 755189702 | MNTQILVFALIAIIPTNADKICLGHHAVSNGTKVNTL TERGVEVVNATETVERTTIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSRGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 383 |
| AJJ97582 A/chicken/Jiangxi/ 14023/2014 2014/04/13 HA 755189933 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | 384 |

TABLE 15-continued

H10 Hemagglutinin Amino Acid Sequences

| SEQ ID NO: | Accession No/ Strain/Protein | Amino Acid Sequence | SEQ ID NO: |
|---|---|---|---|
| | AJJ97697 A/chicken/Jiangxi/ 14517/2014 2014/04/20 HA 755190125 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCDGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELIDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 385 |
| | AJJ97709 A/chicken/Jiangxi/ 14518/2014 2014/04/20 HA 755190145 | MNTQILVFALIAIIPANADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYNGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGNCYHSGGT IISNLPFQNIDSRAVGKCPRYVKQRSLLLATGMKNVP EIPKGRGLFGAIAGFIENGWEGLIDGWYGFRHQNAQG EGTAADYKSTQSAIDQITGKLNRLIAKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHRKYREEAMQNRIQIDPVKLS SGYKDVILWFSFGASCFILLAIVMGLVFICVKNGNMR CTICI | 386 |
| | AJJ97745 A/chicken/Jiangxi/ 14554/2014 2014/04/20 HA 755190205 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA LIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDANCEGDCYHSGGT IISNLPFQNIDSRAVGKCPRYVKQKSLLLATGMKNVP EIPKGRGLFGAIAGFIENGWEGLIDGWYGFRHQNAQG EGTAADYKSTQSAIDQITGKLNRLIEKTNQQFELMDN EFNEVEKQIGNVINWTRDSITELWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 387 |
| | AJJ97757 A/chicken/Shantou/ 2537/2014 2014/04/16 HA 755190225 | MNTQILVFALIAIIPTNADKICLGHHAVSNGTKVNTL TERGVEVVNATETVERTNIPRICSKGKKTVDLGQCGL LGTITGPPQCDQFLEFSADLIIERREGSDVCYPGKFV NEEALRQILRKSGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA FIAPDRASFLRGKSMGIQSGVQVDADCEGDCYHSGGT IISNLPFQNIDSRAVGKCPRYVKQRSLLLATGMKNVP EIPKGRGLFGAIAGFIENGWEGLIDGWYGFKHQNAQG EGTAADYKSTQSAIDQITGKLNRLIEKTNQQFELIDN EFNEVEKQIGNVINWTRDSITEVWSYNAELLVAMENQ HTIDLADSEMDKLYERVKRQLRENAEEDGTGCFEIFH KCDDDCMASIRNNTYDHSKYREEAMQNRIQIDPVKLS SGYKDVILWFSFGASCFILLAIVMGLVFICVKNGNMR CTICI | 388 |
| | AJJ97841 A/duck/Jiangxi/ 15044/2014 2014/04/27 HA 755190365 | MNTQILVFALIAIIPTNADKICLGHHAVSNGTKVNTL TERGVEVVNATETVERTNIPRICSKGKRTVDLGQCGL LGTITGPPQCDQFLEFSADLIIERREGSDVCYPGKFV NEEALRQILRESGGIDKEAMGFTYSGIRTNGATSACR RSGSSFYAEMKWLLSNTDNAAFPQMTKSYKNTRKSPA IIVWGIHHSVSTAEQTKLYGSGNKLVTVGSSNYQQSF VPSPGARPQVNGLSGRIDFHWLMLNPNDTVTFSFNGA | 389 |

TABLE 15-continued

H10 Hemagglutinin Amino Acid Sequences

| SEQ ID NO: Accession No/Strain/Protein | Amino Acid Sequence | SEQ ID NO: |
|---|---|---|
| | FIAPDRASFLRGKSMGIQSGVQVDANCEGDCYHSGGT<br>IISNLPFQNIDSRAVGKCPRYVKQRSLLLATGMKNVP<br>EIPKGRGLFGAIAGFIENGWEGLIDGWYGFRHQNAQG<br>EGTAADYKSTQSAIDQITGKLNRLIAKTNQQFELIDN<br>EFNEVEKQIGNVINWTRDSITEVWSYNAELLVAMENQ<br>HTIDLADSEMDKLYERVKRQLRENAEEDGTGCFEIFH<br>KCDDDCMASIRNNTYDHRKYREEAMQNRIQIDPVRLS<br>SGYKDVILWFSFGASCFILLAIVMGLVFICVKNGNMR<br>CTICI | |
| AJJ97899<br>A/chicken/Jiangxi/<br>15524/2014<br>2014/05/05 HA<br>755190462 | MNTQILVFALIAIIPTNADKICLGHHAVSNGTKVNTL<br>TERGVEVVNATETVERTNIPRICSKGKRTVDLGQCGL<br>LGTITGPPQCDQFLEFSADLIIERREGSDVCYPGKFV<br>NEEALRQILRESGGIDKEAMGFTYSGIRTNGATSACR<br>RSGSSFYAEMKWLLSNTDNAAFPQMTKSYKNTRKSPA<br>IIVWGIHHSVSTAEQTKLYGSGNKLVTVGSSNYQQSF<br>VPSPGARPQVNGLSGRIDFHWLMLNPNDTVTFSFNGA<br>FIAPDRASFLRGKSMGIQSGVQVDANCEGDCYHSGGT<br>IISNLPFQNIDSRAVGKCPRYVKQRSLLLATGMKNVP<br>EIPKGRGLFGAIAGFIENGWEGLIDGWYGFRHQNAQG<br>EGTAADYKSTQSAIDQITGKLNRLIAKTNQQFELIDN<br>EFNEVEKQIGNVINWTRDSITEVWSYNAELLVAMENQ<br>HTIDLADSEMDKLYERVKRQLRENAEEDGTGCFEIFH<br>KCDDDCMASIRNNTYDHRKYREEAMQNRIQIDPVKLS<br>SGYKDVILWFSFGASCFILLAIVMGLVFMCVKNGNMR<br>CTICI | 390 |
| AJJ97925<br>A/silkie<br>chicken/Shantou/<br>2050/2014<br>2014/03/25 HA<br>755190506 | MNTQILVFALIAIIPTNADKICLGHHAVSNGTKVNTL<br>TERGVEVVNATETVERTNIPRICSKGKKTVDLGQCGL<br>LGTITGPPQCDQFLEFSADLIIERREGSDVCYPGKFV<br>NEEALRQILRKSGGIDKEAMGFTYSGIRTNGATSACR<br>RSGSSFYAEMKWLLSNTDNAAFPQMTKSYKNTRKSPA<br>IIVWGIHHSVSTAEQTKLYGSGNKLVTVGSSNYQQSF<br>VPSPGARPQVNGLSGRIDFHWLMLNPNDTVTFSFNGA<br>FIAPDRASFLRGKSMGIQSGVQVDADCEGDCYHSGGT<br>IISNLPFQNIDSRAVGKCPRYVKQRSLLLATGMKNVP<br>EVPKGRGLFGAIAGFIENGWEGLIDGWYGFRHQNAQG<br>EGTAADYKSTQSAIDQITGKLNRLIEKTNQQFELIDN<br>EFNEVEKQIGNVINWTRDSITEVWSYNAELLVAMENQ<br>HTIDLADSEMDKLYERVKRQLRENAEEDGTGCFEIFH<br>KCDDDCMASIRNNTYDHSKYREEAMQNRIQIDPVKLS<br>SGYKDVILWFSFGASCFILLAIVMGLVFICVKNGNMR<br>CTICI | 391 |
| AJJ97973<br>A/chicken/Shantou/<br>4325/2014<br>2014/07/01 HA<br>755190586 | MNTQILVFALISIIPTNADKICLGHHAVSNGTKVNTL<br>TERGVEVVNATETVERTNIPRICSKGKKTVDLGQCGL<br>LGTITGPPQCDQFLEFSADLIIERREGSDVCYPGKFV<br>NEEALRQILRKSGGIDKEAMGFTYSGIRINGVISACR<br>RSGSSFYAEMKWLLSNTDNAAFPQMTKSYKNTRKSPA<br>IIVWGIHHSVSTAEQTKLYGSGNKLVTVGSSNYQQSF<br>VPSPGARPQVNGLSGRIDFHWLMLNPNDTVTFSFNGA<br>FIAPDRASFLRGKSMGIQSGVQVDADCEGDCYHSGGT<br>IISNLPFQNIDSRAVGKCPRYVKQRSLLLATGMKNVP<br>EVPKGRGLFGAIAGFIENGWEGLIDGWYGFRHQNAQG<br>EGTAADYKSTQSAIDQITGKLNRLIEKTNQQFELIDN<br>EFNEVEKQIGNVINWTRDSITEVWSYNAELLVAMENQ<br>HTIDLADSEMDKLYERVKRQLRENAEEDGTGCFEIFH<br>KCDDDCMASIRNNTYDHSKYREEAMQNRIQIDPVKLS<br>SGYKDVILWFSFGASCFILLAIVMGLVFICVKNGNMR<br>CTICI | 392 |
| AJJ97998<br>A/chicken/Shantou/<br>4816/2014<br>2014/07/22 HA<br>755190628 | MNTQILVFALIAIVPTNADKICLGHHAVSNGTKVNTL<br>TERGVEVVNATETVERTNIPRICSKGKKTVDLGQCGL<br>LGTITGPPQCDQFLEFSADLIIERREGSDVCYPGKFV<br>NEEALRQILRESGGIDKEAMGFTYSGIRTNGATSACR<br>RSGSSFYAEMKWLLSNTDNAAFPQMTKSYKNTRKSPA<br>LIVWGIHHSVSTAEQTKLYGSGNKLVTVGSSNYQQSF<br>VPSPGARPQVNGLSGRIDFHWLMLNPNDTVTFSFNGA<br>FIAPDRASFLRGKSMGIQSGVQVDANCEGDCYHSGGT<br>IISNLPFQNIDSRAVGKCPRYVKQKSLLLATGMKNVP<br>EIPKGRGLFGAIAGFIENGWEGLIDGWYGFRHQNAQG<br>EGTAADYKSTQSAIDQITGKLNRLIEKTNQQFELVDN<br>EFNEVEKQIGNVINWTRDSITEVWSYNAELLVAMENQ<br>HTIDLADSEMDKLYERVKRQLRENAEEDGTGCFEIFH<br>KCDDDCMASIRNNTYDHSKYREEAMQNRIQIDPVKLS | 393 |

TABLE 15-continued

| H10 Hemagglutinin Amino Acid Sequences | | | |
|---|---|---|---|
| SEQ ID NO: | Accession No/ Strain/Protein | Amino Acid Sequence | SEQ ID NO: |
| | | SGYKDVILWFSFGASCFILLAIVMGLVFICVKNGNMRCTICI | |

TABLE 16

| Exemplary Influenza HA Stem Antigens | | | | |
|---|---|---|---|---|
| Strain | Foldon version | SEQ ID NO: | AA seq | SEQ ID NO: |
| H1N1 A/Puerto Rico/8/1934 | DTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTYNAELLVLLENERTLDAHDSQGTgggyipeaprdgqayvrkdgewvllstfl | 394 | METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTYNAELLVLLENERTLDAHDSQGTGGGYIPEAPRDGQAYVRKDGEWVLLSTFL | 403 |
| H1N1 A/VietNam/850/2009 | DTVDTVLEKNVTVTHSVNLLEDKHGSANTSLPFQNTHPTTNGKCPKYVKSTKLRLATGLRNGSAGSATQNAIDEITNKVNSVIEKMNTQDTATGKEFNHDEKRIENLNKKVDDGFLDIWTYNAELLVLLENERTLDAHDSQGTgggyipeaprdgqayvrkdgewvllstfl | 395 | METPAQLLFLLLLWLPDTTGDTVDTVLEKNVTVTHSVNLLEDKHGSANTSLPFQNTHPTTNGKCPKYVKSTKLRLATGLRNGSAGSATQNAIDEITNKVNSVIEKMNTQDTATGKEFNHDEKRIENLNKKVDDGFLDIWTYNAELLVLLENERTLDAHDSQGTGGGYIPEAPRDGQAYVRKDGEWVLLSTFL | 404 |
| H1N1 A/New Caledonia/20/99 | DTVDTVLEKNVTVTHSVNLLEDSHGSANSSLPFQNTHPTTNGESPKYVRSAKLRMVTGLRNGSAGSATQNAINGITNKVNSVIEKMNTQDTAVGKEFNKDERRMENLNKKVDDGFLDIWTYNAELLVLLENERTLDAHDSQGTgggyipeaprdgqayvrkdgewvllstfl | 396 | METPAQLLFLLLLWLPDTTGDTVDTVLEKNVTVTHSVNLLEDSHGSANSSLPFQNTHPTTNGESPKYVRSAKLRMVTGLRNGSAGSATQNAINGITNKVNSVIEKMNTQDTAVGKEFNKDERRMENLNKKVDDGFLDIWTYNAELLVLLENERTLDAHDSQGTGGGYIPEAPRDGQAYVRKDGEWVLLSTFL | 405 |
| H1N1 A/California/04/2009 | DTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTYNAELLVLLENERTLDAHDSQGTgggyipeaprdgqayvrkdgewvllstfl | 397 | METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTYNAELLVLLENERTLDAHDSQGTGGGYIPEAPRDGQAYVRKDGEWVLLSTFL | 406 |
| H3N2 A/Wisconsin/67/2005 | HAVPNGTIVKTITNDQIEVTNATEgsaPNDKPFQNtNRtTtGACPRYVKQNTLKLATGMRNgsagsaTQAAINQINGKLNRLIGKTNEKdHQdEKEFSEdEGRIQDLEKYVEDTKIDLWSYNAELLVALENQHTIDaTDSQGTgggyipeaprdgqayvrkdgewvllstfl | 398 | METPAQLLFLLLLWLPDTTGHAVPNGTIVKTITNDQIEVTNATEGSAPNDKPFQNTNRTTTGACPRYVKQNTLKLATGMRNGSAGSATQAAINQINGKLNRLIGKTNEKDHQDEKEFSEDEGRIQDLEKYVEDTKIDLWSYNAELLVALENQHTIDATDSQGTGGGYIPEAPRDGQAYVRKDGEWVLLSTFL | 407 |
| H5N1 A/Vietnam/1203/2004 | EQVDTIMEKNVTVTHAQDILEKTHGSANSSMPFHNTHPNTTGESPKYVKSNRLVLATGLRNGSAGSATQKAIDGVTNKVNSIIDKMNTQFEADGREFNNDERRIENLNKKMEDGFLDVWTYNAELLVLMENER | 399 | METPAQLLFLLLLWLPDTTGEQVDTIMEKNVTVTHAQDILEKTHGSANSSMPFHNTHPNTTGESPKYVKSNRLVLATGLRNGSAGSATQKAIDGVTNKVNSIIDKMNTQFEADGREFNNDERRIENLNKKMEDGFLDVWTYNAELLVLMENERT | 408 |

TABLE 16-continued

Exemplary Influenza HA Stem Antigens

| Strain | Foldon version | SEQ ID NO: | AA seq | SEQ ID NO: |
|---|---|---|---|---|
| | TLDAHDSQGTgggyipeaprdgqayvrkdgewvllstfl | | LDAHDSQGTGGGYIPEAPRDGQAYVRKDGEWVLLSTFL | |
| H7N9 (A/Anhui/1/2013) | TKVNTLTERGVEVVNATETVERTgsaISNLPFQNtDStAnGKCPRYVKQRSLLLATGMKNgsagsaTQSAIDQITGKLNRLIEKTNQQdELtDNEFNEdEKQIGNVINWTRDSITEVWSYNAELLVAMENQHTIDaADSQGTgggyipeaprdgqayvrkdgewvllstfl | 400 | METPAQLLFLLLLWLPDTTGTKVNTLTERGVEVVNATETVERTGSAISNLPFQNTDSTANGKCPRYVKQRSLLLATGMKNGSAGSATQSAIDQITGKLNRLIEKTNQQDELTDNEFNEDEKQIGNVINWTRDSITEVWSYNAELLVAMENQHTIDAADSQGTGGGYIPEAPRDGQAYVRKDGEWVLLSTFL | 409 |
| H9N2 A/Hong Kong/1073/99 | ETVDTLTETNVPVTHAKELLHTEHgsaNSTLPFHNtSKtAnGTCPKYVRVNSLKLAVGLRNgsagsaTQKAIDKITSKVNNIVDKMNKQdEItDHEFSEdETRLNMINNKIDDQIQDVWAYNAELLVLLENQKTLDaHDSQGTgggyipeaprdgqayvrkdgewvllstfl | 401 | METPAQLLFLLLLWLPDTTGETVDTLTETNVPVTHAKELLHTEHGSANSTLPFHNTSKTANGTCPKYVRVNSLKLAVGLRNGSAGSATQKAIDKITSKVNNIVDKMNKQDEITDHEFSEDETRLNMINNKIDDQIQDVWAYNAELLVLLENQKTLDAHDSQGTGGGYIPEAPRDGQAYVRKDGEWVLLSTFL | 410 |
| H10N8 A/JX346/2013 | TIVKTLTNEQEEVTNATETVESTGgsaNTRLPFQNtSPtTnGQCPKYVNRRSLMLATGMRNgsagsaTQAAIDQITGKLNRLVEKTNTEdSItSEFSEIEHQIGNVINWTKDSITDIWTYQAELLVAMENQHTIDaADSQGTgggyipeaprdgqayvrkdgewvllstfl | 402 | METPAQLLFLLLLWLPDTTGTIVKTLTNEQEEVTNATETVESTGGSANTRLPFQNTSPTTNGQCPKYVNRRSLMLATGMRNGSAGSATQAAIDQITGKLNRLVEKTNTEDSITSEFSEIEHQIGNVINWTKDSITDIWTYQAELLVAMENQHTIDAADSQGTGGGYIPEAPRDGQAYVRKDGEWVLLSTFL | 411 |
| H3N2 A/Hong Kong/1/1968 stem RNA | | | METPAQLLFLLLLWLPDTTGASPNGTLVKTITDDQIEVTNATELVQSSGSAGSANDKPFQNTNKRTSGASPKYVKQNTLKLATGQRGSAGSAATDQINGKLNRVIEKTNEKDHQIEKEFSEDEGRIQDLEKYVEDTKIDLWSYNAELLVALENQHTIDLTDSQGTGGGYIPEAPRDGQAYVRKDGEWVLLSTFL | 412 |

The first underlined sequence for each of the amino acid sequences listed in Table 16, indicates a signal or secretory sequence, which may be substituted by an alternative sequence that achieves the same or similar function, or the signal or secretory sequence may be deleted. The second underlined sequence for the amino acid sequences listed in Table 16, indicates a foldon sequence, which is a heterologous sequence that naturally trimerizes, to bring 3 HA stems together in a trimer. Such foldon sequence may be substituted by an alternative sequence, which achieves the same or similar function.

TABLE 17

Exemplary Influenza Constructs

| Construct Description | ORF | SEQ ID NO: |
|---|---|---|
| Influenza H3HA6 | METPAQLLFLLLLWLPDTTGGLFGAIAGFIENGWEGMIDGWYGFRHQNSEGTGQAADLKSTQAAIDQINGKLNRVIEKTNEKDHQIEKEFSEDEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQGSAGSAGDNSTATLCLGHHAVPNGTLVKTITDDQIEVTNATELVQSSGSAGSANDKPFQNTNKETTGATPKYVKQNTLKLATGMR | 413 |
| Influenza H1HA6 | METPAQLLFLLLLWLPDTTGGLFGAIAGFIEGGWTGMIDGWYGYHHQNEQGSGYAADQKSTQNAINGITNKVNTVIEKMNIQDTATGKEFNKDEKRMENLNKKVDDGFLDIWTYNAELLVLLENERTLDFHDSNVKNLYEKVKSQLKNNAKEIGNGCFEFYHKCDNECMESVRNGTYDYPKYSE | 414 |

TABLE 17-continued

| Exemplary Influenza Constructs | | |
|---|---|---|
| Construct Description | ORF | SEQ ID NO: |
| | ESKLNREKGSAGSAAADADTICIGYHANNSTDTVDTVLEKNVTVTH<br>SVNLLEDSHGSANSSLPYQNTHPTTNGESPKYVRSAKLRMVTGLRN<br>IP | |
| Influenza H1HA10-Foldon_ΔNgly1 | METPAQLLFLLLLWLPDTTGDTVDTVLEKNVTVTHSVNLLEDSHGS<br>ANSSLPYQNTHPTTNGESPKYVRSAKLRMVTGLRNGGAGSATQNAI<br>NGITNKVNTVIEKMNIQDTATGKEFNKDEKRMENLNKKVDDGFLDI<br>WTYNAELLVLLENERTLDAHDSQGTGGGYIPEAPRDGQAYVRKDGE<br>WVLLSTFL | 415 |
| Influenza eH1HA | METPAQLLFLLLLWLPDTTGDTICIGYHANNSTDTVDTVLEKNVTV<br>THSVNLLEDSHNGKLCRLKGIAPLQLGKCNIAGWLLGNPECDPLLP<br>VRSWSYIVETPNSENGICYPGDFIDYEELREQLSSVSSFERFEIFP<br>KESSWPNHNTNGVTAACSHEGKSSFYRNLLWLTEKEGSYPNLKNSY<br>VNKKGKEVLVLWGIHHPSNSKEQQNLYQNENAYVSVVTSNYNRRFT<br>PEIAERPKVRDQAGRMNYYWTLLKPGDTIIFEANGNLIAPMYAFAL<br>SRGFGSGIITSNASMHECNTKCQTPLGAINSSLPYQNIHPVTIGEC<br>PKYVRSAKLRMVTGLRNIPSIQSRGLFGAIAGFIEGGWTGMIDGWY<br>GYHHQNEQGSGYAADQKSTQNAINGITNKVNTVIEKMNIQFTAVGK<br>EFNKLEKRMENLNKKVDDGFLDIWTYNAELLVLLENERTLDFHDSN<br>VKNLYEKVKSQLKNNAKEIGNGCFEFYHKCDNECMESVRNGTYDYP<br>KYSEESKLNREKVDGVKLESMGIGSAGSAGYIPEAPRDGQAYVRKD<br>GEWVLLSTFL | 416 |
| Influenza eH1HA_Native SS | MKANLLVLLCALAAADADTICIGYHANNSTDTVDTVLEKNVTVTHS<br>VNLLEDSHNGKLCRLKGIAPLQLGKCNIAGWLLGNPECDPLLPVRS<br>WSYIVETPNSENGICYPGDFIDYEELREQLSSVSSFERFEIFPKES<br>SWPNHNTNGVTAACSHEGKSSFYRNLLWLTEKEGSYPNLKNSYVNK<br>KGKEVLVLWGIHHPSNSKEQQNLYQNENAYVSVVTSNYNRRFTPEI<br>AERPKVRDQAGRMNYYWTLLKPGDTIIFEANGNLIAPMYAFALSRG<br>FGSGIITSNASMHECNTKCQTPLGAINSSLPYQNIHPVTIGECPKY<br>VRSAKLRMVTGLRNIPSIQSRGLFGAIAGFIEGGWTGMIDGWYGYH<br>HQNEQGSGYAADQKSTQNAINGITNKVNTVIEKMNIQFTAVGKEFN<br>KLEKRMENLNKKVDDGFLDIWTYNAELLVLLENERTLDFHDSNVKN<br>LYEKVKSQLKNNAKEIGNGCFEFYHKCDNECMESVRNGTYDYPKYS<br>EESKLNREKVDGVKLESMGIGSAGSAGYIPEAPRDGQAYVRKDGEW<br>VLLSTFL | 417 |
| H1HA10TM-PR8 (H1 A/Puerto Rico/8/34 HA), with TM domain, without foldon (with IgG Kappa leader) | METPAQLLFLLLLWLPDTTGDTVDTVLEKNVTVTHSVNLLEDSHGS<br>ANSSLPYQNTHPTTNGESPKYVRSAKLRMVTGLRNGSAGSATQNAI<br>NGITNKVNTVIEKMNIQDTATGKEFNKDEKRMENLNKKVDDGFLDI<br>WTYNAELLVLLENERTLDAHDSQGTGGILAIYSTVASSLVLLVSLG<br>AISFWMCSNGSLQCRICI | 418 |
| H1HA10-PR8-DS (H1 A/Puerto Rico/8/34 HA), ds bond, without foldon (with IgG Kappa leader) | METPAQLLFLLLLWLPDTTGDTVDTVCEKNVTVTHSVNLLEDSHGS<br>ANSSLPYQNTHPTTNGESPKYVRSAKLRMVTGLRNGSAGSATQNAI<br>NCITNKVNTVIEKMNIQDTATGKEFNKDEKRMENLNKKVDDGFLDI<br>WTYNAELLVLLENERTLDAHDS | 419 |
| pH1HA10-Cal04-DS (H1 A/California/04/2009 HA), ds bond, without foldon (with IgG Kappa leader) | METPAQLLFLLLLWLPDTTGDTVDTVCEKNVTVTHSVNLLEDKHGS<br>ANTSLPFQNTHPTTNGKSPKYVKSTKLRLATGLRNGSAGSATQNAI<br>DCITNKVNSVIEKMNTQDTAVGKEFNHDEKRIENLNKKVDDGFLDI<br>WTYNAELLVLLENERTLDAHDS | 420 |
| Nucleoprotein from H3N2 (no IgG Kappa leader) | MASQGTKRSYEQMETDGERQNATEIRASVGKMIDGIGRFYIQMCTE<br>LKLSDYEGRLIQNSLTIERMVLSAFDERRNRYLEEHPSAGKDPKKT<br>GGPIYKRVDGRWMRELVLYDKEEIRRIWRQANNGDDATAGLTHMMI<br>WHSNLNDTTYQRTRALVRTGMDPRMCSLMQGSTLPRRSGAAGAAVK<br>GIGTMVMELIRMIKRGINDRNFWRGENGRKTRSAYERMCNILKGKF<br>QTAAQRAMMDQVRESRNPGNAEIEDLIFSARSALILRGSVAHKSCL<br>PACVYGPAVSSGYNFEKEGYSLVGIDPFKLLQNSQVYSLIRPNENP<br>AHKSQLVWMACHSAAFEDLRLLSFIRGTKVSPRGKLSTRGVQIASN<br>ENMDNMESSTLELRSRYWAIRTRSGGNTNQQRASAGQISVQPTFSV | 421 |

TABLE 17-continued

Exemplary Influenza Constructs

| Construct Description | ORF | SEQ ID NO: |
|---|---|---|
| | QRNLPFEKSTVMAAFTGNTEGRTSDMRAEIIRMMEGAKPEEVSFRG RGVFELSDEKATNPIVPSFDMSNEGSYFFGDNAEEYDN | |
| HA10 version for Influenza B strain | METPAQLLFLLLLWLPDTTGHVVKTATQGEVNVTGVIPLTTTPTGS ANKSKPYYTGEHAKAIGNCPIWVKTPLKLANGTKYGSAGSATQEAI NKITKNLNSLSELEVKNLQRLSGAMDELHNEILELDEKVDDLRADT ISSQIELAVLLSNEGIINSEDEGTGGGYIPEAPRDGQAYVRKDGEW VLLSTFL | 422 |
| B/Yamagata/16/ 1988 mHA | MKAIIVLLMVVTSNADRICTGITSSNSPHVVKTATQGEVNVTGVIP LTTTPTKSHFANLKGTKTRGKLCPNCLNCTDLDVALGRPMCMGTIP SAKASILHEVRPVTSGCFPIMHDRTKIRQLPNLLRGYENIRLSTHN VINAERAPGGPYRLGTSGSCPNVTSRNGFFATMAWAVPRDNKTATN PLTVEVPYICTKGEDQITVWGFHSDDKTQMKNLYGDSNPQKFTSSA NGVTTHYVSQIGDFPNQTEDGGLPQSGRIVVDYMVQKPGKTGTIVY QRGVLLPQKVWCASGRSKVIKGSLPLIGEADCLHEKYGGLNKSKPY YTGEHAKAIGNCPIWVKTPLKLANGTKYRPPAKLLKERGFFGAIAG FLEGGWEGMIAGWHGYTSHGAHGVAVAADLKSTQEAINKITKNLNS LSELEVKNLQRLSGAMDELHNEILELDEKVDDLRADTISSQIELAV LLSNEGIINSEDEHLLALERKLKKMLGPSAVDIGNGCFETKHKCNQ TCLDRIAAGTFNAGEFSLPTFDSLNITAASLNDDGLDNHTILLYYS TAASSLAVTLMIAIFIVYMVSRDNVSCSICL | 423 |
| B/Yamagata/16/ 1988 sHA | MKAIIVLLMVVTSNADRICTGITSSNSPHVVKTATQGEVNVTGVIP LTTTPTKSHFANLKGTKTRGKLCPNCLNCTDLDVALGRPMCMGTIP SAKASILHEVRPVTSGCFPIMHDRTKIRQLPNLLRGYENIRLSTHN VINAERAPGGPYRLGTSGSCPNVTSRNGFFATMAWAVPRDNKTATN PLTVEVPYICTKGEDQITVWGFHSDDKTQMKNLYGDSNPQKFTSSA NGVTTHYVSQIGDFPNQTEDGGLPQSGRIVVDYMVQKPGKTGTIVY QRGVLLPQKVWCASGRSKVIKGSLPLIGEADCLHEKYGGLNKSKPY YTGEHAKAIGNCPIWVKTPLKLANGTKYRPPAKLLKERGFFGAIAG FLEGGWEGMIAGWHGYTSHGAHGVAVAADLKSTQEAINKITKNLNS LSELEVKNLQRLSGAMDELHNEILELDEKVDDLRADTISSQIELAV LLSNEGIINSEDEHLLALERKLKKMLGPSAVDIGNGCFETKHKCNQ TCLDRIAAGTFNAGEFSLPTFDSLNITAASLNDDGLDNHT | 424 |
| B/Victoria/02/ 1987 mHA | MKAIIVLLMVVTSNADRICTGITSSNSPHVVKTATQGEVNVTGVIP LTTTPTKSHFANLKGTKTRGKLCPKCLNCTDLDVALGRPKCTGTIP SAKASILHEVKPVTSGCFPIMHDRTKIRQLPNLLRGYEHIRLSTHN VINAETAPGGPYKVGTSGSCPNVTNGNGFFATMAWAVPKNDNNKTA TNPLTVEVPYICTEGEDQITVWGFHSDNEAQMVKLYGDSKPQKFTS SANGVTTHYVSQIGGFPNQAEDGGLPQSGRIVVDYMVQKSGKTGTI TYQRGILLPQKVWCASGRSKVIKGSLPLIGEADCLHEKYGGLNKSK PYYTGEHAKAIGNCPIWVKTPLKLANGTKYRPPAKLLKEKGFFGAI AGFLEGGWEGMIAGWHGYTSHGAHGVAVAADLKSTQEAINKITKNL NSLSELEVKNLQRLSGAMDELHNKILELDEKVDDLRADTISSQIEL AVLLSNEGIINSEDEHLLALERKLKKMLGPSAVEIGNGCFETKHKC NQTCLDRIAAGTFNAGEFSLPTFDSLNITAASLNDDGLDNHTILLY YSTAASSLAVTLMIAIFIVYMVSRDNVSCSICl | 425 |
| B/Victoria/02/ 1987 sHA | MKAIIVLLMVVTSNADRICTGITSSNSPHVVKTATQGEVNVTGVIP LTTTPTKSHFANLKGTKTRGKLCPKCLNCTDLDVALGRPKCTGTIP SAKASILHEVKPVTSGCFPIMHDRTKIRQLPNLLRGYEHIRLSTHN VINAETAPGGPYKVGTSGSCPNVTNGNGFFATMAWAVPKNDNNKTA TNPLTVEVPYICTEGEDQITVWGFHSDNEAQMVKLYGDSKPQKFTS SANGVTTHYVSQIGGFPNQAEDGGLPQSGRIVVDYMVQKSGKTGTI TYQRGILLPQKVWCASGRSKVIKGSLPLIGEADCLHEKYGGLNKSK PYYTGEHAKAIGNCPIWVKTPLKLANGTKYRPPAKLLKEKGFFGAI AGFLEGGWEGMIAGWHGYTSHGAHGVAVAADLKSTQEAINKITKNL NSLSELEVKNLQRLSGAMDELHNKILELDEKVDDLRADTISSQIEL AVLLSNEGIINSEDEHLLALERKLKKMLGPSAVEIGNGCFETKHKC NQTCLDRIAAGTFNAGEFSLPTFDSLNITAASLNDDGLDNHT | 426 |
| B/Brisbane/60/ 2008 mHA | MKAIIVLLMVVTSNADRICTGITSSNSPHVVKTATQGEVNVTGVIP LTTTPTKSHFANLKGTETRGKLCPKCLNCTDLDVALGRPKCTGKIP SARVSILHEVRPVTSGCFPIMHDRTKIRQLPNLLRGYEHIRLSTHN VINAENAPGGPYKIGTSGSCPNITNGNGFFATMAWAVPKNDKNKTA TNPLTIEVPYICTEGEDQITVWGFHSDNETQMAKLYGDSKPQKFTS SANGVTTHYVSQIGGFPNQTEDGGLPQSGRIVVDYMVQKSGKTGTI TYQRGILLPQKVWCASGRSKVIKGSLPLIGEADCLHEKYGGLNKSK PYYTGEHAKAIGNCPIWVKTPLKLANGTKYRPPAKLLKERGFFGAI AGFLEGGWEGMIAGWHGYTSHGAHGVAVAADLKSTQEAINKITKNL NSLSELEVKNLQRLSGAMDELHNEILELDEKVDDLRADTISSQIEL AVLLSNEGIINSEDEHLLALERKLKKMLGPSAVEIGNGCFETKHKC | 427 |

TABLE 17-continued

Exemplary Influenza Constructs

| Construct Description | ORF | SEQ ID NO: |
|---|---|---|
| | NQTCLDRIAAGTFDAGEFSLPTFDSLNITAASLNDDGLDNHTILLY YSTAASSLAVTLMIAIFVVYMVSRDNVSCSICL | |
| B/Brisbane/60/ 2008 sHA | MKAIIVLLMVVTSNADRICTGITSSNSPHVVKTATQGEVNVTGVIP LTTTPTKSHFANLKGTETRGKLCPKCLNCTDLDVALGRPKCTGKIP SARVSILHEVRPVTSGCFPIMHDRTKIRQLPNLLRGYEHIRLSTHN VINAENAPGGPYKIGTSGSCPNITNGNGFFATMAWAVPKNDKNKTA TNPLTIEVPYICTEGEDQITVWGFHSDNETQMAKLYGDSKPQKFTS SANGVTTHYVSQIGGFPNQTEDGGLPQSGRIVVDYMVQKSGKTGTI TYQRGILLPQKVWCASGRSKVIKGSLPLIGEADCLHEKYGGLNKSK PYYTGEHAKAIGNCPIWVKTPLKLANGTKYRPPAKLLKERGFFGAI AGFLEGGWEGMIAGWHGYTSHGAHGVAVAADLKSTQEAINKITKNL NSLSELEVKNLQRLSGAMDELHNEILELDEKVDDLRADTISSQIEL AVLLSNEGIINSEDEHLLALERKLKKMLGPSAVEIGNGCFETKHKC NQTCLDRIAAGTFDAGEFSLPTFDSLNITAASLNDDGLDNHT | 428 |
| B/Phuket/3073/ 2013 mHA | MKAIIVLLMVVTSNADRICTGITSSNSPHVVKTATQGEVNVTGVIP LTTTPTKSYFANLKGTRTRGKLCPDCLNCTDLDVALGRPMCVGTTP SAKASILHEVRPVTSGCFPIMHDRTKIRQLPNLLRGYEKIRLSTQN VIDAEKAPGGPYRLGTSGSCPNATSKIGFFATMAWAVPKDNYKNAT NPLTVEVPYICTEGEDQITVWGFHSDNKTQMKSLYGDSNPQKFTSS ANGVTTHYVSQIGDFPDQTEDGGLPQSGRIVVDYMMQKPGKTGTIV YQRGVLLPQKVWCASGRSKVIKGSLPLIGEADCLHEKYGGLNKSKP YYTGEHAKAIGNCPIWVKTPLKLANGTKYRPPAKLLKERGFFGAIA GFLEGGWEGMIAGWHGYTSHGAHGVAVAADLKSTQEAINKITKNLN SLSELEVKNLQRLSGAMDELHNEILELDEKVDDLRADTISSQIELA VLLSNEGIINSEDEHLLALERKLKKMLGPSAVDIGNGCFETKHKCN QTCLDRIAAGTFDAGEFSLPTFDSLNITAASLNDDGLDNHTILLYY STAASSLAVTLMLAIFIVYMVSRDNVSCSICL | 429 |
| B/Phuket/3073/ 2013 sHA | MKAIIVLLMVVTSNADRICTGITSSNSPHVVKTATQGEVNVTGVIP LTTTPTKSYFANLKGTRTRGKLCPDCLNCTDLDVALGRPMCVGTTP SAKASILHEVRPVTSGCFPIMHDRTKIRQLPNLLRGYEKIRLSTQN VIDAEKAPGGPYRLGTSGSCPNATSKIGFFATMAWAVPKDNYKNAT NPLTVEVPYICTEGEDQITVWGFHSDNKTQMKSLYGDSNPQKFTSS ANGVTTHYVSQIGDFPDQTEDGGLPQSGRIVVDYMMQKPGKTGTIV YQRGVLLPQKVWCASGRSKVIKGSLPLIGEADCLHEKYGGLNKSKP YYTGEHAKAIGNCPIWVKTPLKLANGTKYRPPAKLLKERGFFGAIA GFLEGGWEGMIAGWHGYTSHGAHGVAVAADLKSTQEAINKITKNLN SLSELEVKNLQRLSGAMDELHNEILELDEKVDDLRADTISSQIELA VLLSNEGIINSEDEHLLALERKLKKMLGPSAVDIGNGCFETKHKCN QTCLDRIAAGTFDAGEFSLPTFDSLNITAASLNDDGLDNHT | 430 |
| Pandemic H1HA10 from California 04 strain, without foldon and with ferritin fusion for particle formation | METPAQLLFLLLLWLPDTTGDTVDTVLEKNVTVTHSVNLLEDKHGS ANTSLPFQNTHPTTNGKSPKYVKSTKLRLATGLRNGSAGSATQNAI DEITNKVNSVIEKMNTQDTAVGKEFNHDEKRIENLNKKVDDGFLDI WTYNAELLVLLENERTLDAHDSQGTGGDIIKLLNEQVNKEMQSSNL YMSMSSWCYTHSLDGAGLFLFDHAAEEYEHAKKLIIFLNENNVPVQ LTSISAPEHKFEGLTQIFQKAYEHEQHISESINNIVDHAIKSKDHA TFNFLQWYVAEQHEEEVLFKDILDKIELIGNENHGLYLADQYVKGI AKSRKS | 431 |
| Gen6 HA SS construct with ferritin | METPAQLLFLLLLWLPDTTGDTICIGYHANNSTDTVDTVLEKNVTV THSVNLGSGLRMVTGLRNIPQRETRGLFGAIAGFIEGGWTGMVDGW YGYHHQNEQGSGYAADQKSTQNAINGITNMVNSVIEKMGSGGSGTD LAELLVLLLNERTLDFHDSNVKNLYEKVKSQLKNNAKEIGNGCFEF YHKCNNECMESVKNGTYDYPKYSEESKLNREKIDSGGDIIKLLNEQ VNKEMQSSNLYMSMSSWCYTHSLDGAGLFLFDHAAEEYEHAKKLII FLNENNVPVQLTSISAPEHKFEGLTQIFQKAYEHEQHISESINNIV DHAIKSKDHATFNFLQWYVAEQHEEEVLFKDILDKIELIGNENHGL YLADQYVKGIAKSRKS | 432 |
| Gen6 HA SS construct with foldon | METPAQLLFLLLLWLPDTTGDTICIGYHANNSTDTVDTVLEKNVTV THSVNLGSGLRMVTGLRNIPQRETRGLFGAIAGFIEGGWTGMVDGW YGYHHQNEQGSGYAADQKSTQNAINGITNMVNSVIEKMGSGGSGTD LAELLVLLLNERTLDFHDSNVKNLYEKVKSQLKNNAKEIGNGCFEF YHKCNNECMESVKNGTYDYPKYSEESKLNREKIDPGSGYIPEAPRD GQAYVRKDGEWVLLSTFL | 433 |
| #4900 construct without cleavage site and tag | METPAQLLFLLLLWLPDTTGDTICIGYHANNSTDTVDTVLEKNVTV THSVNLLENGGGGKYVCSAKLRMVTGLRNKPSKQSQGLFGAIAGFT EGGWTGMVDGWYGYHHQNEQGSGYAADQKSTQNAINGITNKVNSVI EKMNTQYTAIGCEYNKSERCMKQIEDKIEEIESKIWCYNAELLVLL ENERTLDFHDSNVKNLYEKVKSQLKNNAKEIGNGCFEFYHKCNDEC MESVKNGTYDYPKYSEESKLNREKIDGVKLESMGVYQ | 434 |

TABLE 17-continued

Exemplary Influenza Constructs

| Construct Description | ORF | SEQ ID NO: |
|---|---|---|
| Pandemic H1HA10 from California 04 strain, without foldon and with Y94D/N95L mutation for trimerization | METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTDLAELLVLLENERTLDAHDS | 435 |
| Pandemic H1HA10 from California 04 strain, without foldon and with K68C/R76C mutation for trimerization | METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGCEFNHDEKCIENLNKKVDDGFLDIWTYNAELLVLLENERTLDAHDS | 436 |
| H1HA10 from A/Puerto Rico/8/34 strain, without foldon and with Y94D/N95L mutation for trimerization | METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTDLAELLVLLENERTLDAHDS | 437 |
| H1HA10 from A/Puerto Rico/8/34 strain, without foldon and with K68C/R76C mutation for trimerization | METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGCEFNKDEKCMENLNKKVDDGFLDIWTYNAELLVLLENERTLDAHDS | 438 |
| >sp\|P06821\|M2_I34A1 Matrix protein 2 OS = Influenza A virus (strain A/Puerto Rico/8/1934 H1N1) GN = M PE = 3 SV = 1 | MSLLTEVETPIRNEWGCRCNGSSDPLAIAANIIGILHLILWILDRLFFKCIYRRFKYGLKGGPSTEGVPKSMREEYRKEQQSAVDADDGHFVSIELE | 439 |
| A Matrix 1 (A/California/04/2009 (H1N1), ACP44152) | MSLLTEVETYVLSIIPSGPLKAEIAQRLESVFAGKNTDLEALMEWLKTRPILSPLTKGILGFVFTLTVPSERGLQRRRFVQNALNGNGDPNNMDRAVKLYKKLKREITFHGAKEVSLSYSTGALASCMGLIYNRMGTVTTEAAFGLVCATCEQIADSQHRSHRQMATTTNPLIRHENRMVLASTTAKAMEQMAGSSEQAAEAMEVANQTRQMVHAMRTIGTHPSSSAGLKDDLLENLQAYQKRMGVQMQRFK | 440 |
| BHA10-2 | METPAQLLFLLLLWLPDTTGHVVKTATQGEVNVTGVIPLTTTPTGSANKSKPYYTGEHAKATGNCPIWVKTPLKLANGTKYGSAGSATQEAINKITKNLNSLSELEVKNLQRLSGASDETHNEILELDEKVDDLRADTISSQIELAVLLSNEGIINSEDEGTGGGYIPEAPRDGQAYVRKDGEWVLLSTFL | 441 |
| BHA10-2* | HVVKTATQGEVNVTGVIPLTTTPTGSANKSKPYYTGEHAKATGNCPIWVKTPLKLANGTKYGSAGSATQEAINKITKNLNSLSELEVKNLQRLSGASDETHNEILELDEKVDDLRADTISSQIELAVLLSNEGIINSEDEGTGGGYIPEAPRDGQAYVRKDGEWVLLSTFL | 442 |
| BHA10-3 | METPAQLLFLLLLWLPDTTGHVVKTATQGEVNVTGVIPLTTTPTGSANKSKPYYTGEHAKATGNCPIWVKTPLKLANGTKYGSAGSATQEAINKITKNLNSLSELEVKNLQRLSCASDETHNCILELDEKVDDLRADTISSLIELAVLLSNEGIINSEDE | 443 |

TABLE 17-continued

Exemplary Influenza Constructs

| Construct Description | ORF | SEQ ID NO: |
|---|---|---|
| BHA10-3* | HVVKTATQGEVNVTGVIPLTTTPTGSANKSKPYYTGEHAKATGNCP IWVKTPLKLANGTKYGSAGSATQEAINKITKNLNSLSELEVKNLQR LSCASDETHNCILELDEKVDDLRADTISSLIELAVLLSNEGIINSE DE | 444 |

5'UTR for each construct:
TCAAGCTTTTGGACCCTCGTACAGAAGCTAATACGACTCACTATAGGGAAATAAGAGAGAAAAGAAGAGTA
AGAAGAAATATAAGAGCCACC (SEQ ID NO: 445)
3'UTR for each construct:
TGATAATAGGCTGGAGCCTCGGTGGCCATGCTTCTTGCCCCTTGGGCCTCCCCCAGCCCCTCCTCCCCTT
CCTGCACCCGTACCCCCGTGGTCTTTGAATAAAGTCTGAGTGGGCGGC (SEQ ID NO: 446)

The first underlined sequence for each of the amino acid sequences listed in Table 17, indicates a signal or secretory sequence, which may be substituted by an alternative sequence that achieves the same or similar function, or the signal or secretory sequence may be deleted.

TABLE 18

Influenza Nucleic Acids

| Construct Description | ORF | SEQ ID NO: |
|---|---|---|
| B/Yamagata/16/ 1988 mHA | ATGAAGGCAATAATTGTACTACTCATGGTAGTAACATCCAACGCAG ATCGAATCTGCACTGGGATAACATCTTCAAACTCACCTCATGTGGT CAAAACAGCTACTCAAGGGGAAGTTAATGTGACTGGTGTGATACCA CTGACAACAACACCAACAAAATCTCATTTTGCAAATCTCAAAGGAA CAAAGACCAGAGGGAAACTATGCCCAAACTGTCTCAACTGCACAGA TCTGGATGTGGCCTTGGGCAGACCAATGTGTATGGGGACCATACCT TCGGCAAAAGCTTCAATACTCCACGAAGTCAGACCTGTTACATCCG GGTGCTTTCCTATAATGCACGACAGAACAAAAATCAGACAGCTACC CAATCTTCTCAGAGGATATGAAAATATCAGATTATCAACCCATAAC GTTATCAACGCAGAAAGGGCACCAGGAGGACCCTACAGACTTGGAA CCTCAGGATCTTGCCCTAACGTTACCAGTAGAAACGGATTCTTCGC AACAATGGCTTGGGCTGTCCCAAGGGACAACAAAACAGCAACGAAT CCACTAACAGTAGAAGTACCATACATTTGCACAAAAGGAGAAGACC AAATTACTGTTTGGGGGTTCCATTCTGATGACAAAACCCAAATGAA AAACCTCTATGGAGACTCAAATCCTCAAAAGTTCACCTCATCTGCC AATGGAGTAACCACACATTATGTTTCTCAGATTGGTGACTTCCCAA ATCAAACAGAAGACGGAGGGCTACCACAAAGCGGCAGAATTGTTGT TGATTACATGGTGCAAAAACCTGGGAAAACAGGAACAATTGTCTAT CAAAGAGGTGTTTTGTTGCCTCAAAAGGTGTGGTGCGCAAGTGGCA GGAGCAAGGTAATAAAAGGGTCCTTGCCTTTAATTGGTGAAGCAGA TTGCCTTCACGAAAAATACGGTGGATTAAACAAAAGCAAGCCTTAC TACACAGGAGAACATGCAAAAGCCATAGGAAATTGCCCAATATGGG TGAAAACACCTTTGAAGCTTGCCAATGGAACCAAATATAGACCTCC TGCAAAACTATTAAAGGAAAGGGTTTCTTCGGAGCTATTGCTGGT TTCTTAGAGGGAGGATGGGAAGGAATGATTGCAGGTTGGCACGGAT ACACATCTCATGGAGCACATGGAGTGGCAGTGGCAGCAGACCTTAA GAGCACGCAAGAAGCCATAAACAAGATAACAAAAAATCTCAATTCT TTGAGTGAGCTAGAAGTAAAGAATCTTCAAAGACTAAGTGGTGCCA TGGATGAACTCCACAACGAAATACTCGAGCTGGATGAGAAAGTGGA TGATCTCAGAGCTGACACAATAAGCTCGCAAATAGAGCTTGCAGTC TTGCTTTCCAACGAAGGAATAATAAACAGTGAAGATGAGCATCTAT TGGCACTTGAGAGAAAACTAAAGAAAATGCTGGGTCCCTCTGCTGT AGACATAGGGAATGGATGCTTCGAAACCAAACACAAGTGCAACCAG ACCTGCTTAGACAGGATAGCTGCTGGCACCTTTAATGCAGGAGAAT TTTCTCTTCCCACTTTTGATTCACTGAATATTACTGCTGCATCTTT AAATGATGATGGATTGGATAATCATACTATACTGCTCTACTACTCA ACTGCTGCTTCTAGTTTGGCCGTAACATTGATGATAGCTATTTTTA TTGTTTATATGGTCTCCAGAGACAATGTTTCTTGCTCCATCTGTCT A | 447 |
| B/Yamagata/16/ 1988 sHA | ATGAAGGCAATAATTGTACTACTCATGGTAGTAACATCCAACGCAG ATCGAATCTGCACTGGGATAACATCTTCAAACTCACCTCATGTGGT CAAAACAGCTACTCAAGGGGAAGTTAATGTGACTGGTGTGATACCA CTGACAACAACACCAACAAAATCTCATTTTGCAAATCTCAAAGGAA CAAAGACCAGAGGGAAACTATGCCCAAACTGTCTCAACTGCACAGA TCTGGATGTGGCCTTGGGCAGACCAATGTGTATGGGGACCATACCT TCGGCAAAAGCTTCAATACTCCACGAAGTCAGACCTGTTACATCCG | 448 |

TABLE 18-continued

| Influenza Nucleic Acids | | |
|---|---|---|
| Construct Description | ORF | SEQ ID NO: |
| | GGTGCTTTCCTATAATGCACGACAGAACAAAAATCAGACAGCTACC<br>CAATCTTCTCAGAGGATATGAAAATATCAGATTATCAACCCATAAC<br>GTTATCAACGCAGAAAGGGCACCAGGAGGACCCTACAGACTTGGAA<br>CCTCAGGATCTTGCCCTAACGTTACCAGTAGAAACGGATTCTTCGC<br>AACAATGGCTTGGGCTGTCCCAAGGGACAACAAAACAGCAACGAAT<br>CCACTAACAGTAGAAGTACCATACATTTGCACAAAAGGAGAAGACC<br>AAATTACTGTTTGGGGGTTCCATTCTGATGACAAAACCCAAATGAA<br>AAACCTCTATGGAGACTCAAATCCTCAAAAGTTCACCTCATCTGCC<br>AATGGAGTAACCACACATTATGTTTCTCAGATTGGTGACTTCCCAA<br>ATCAAACAGAAGACGGAGGGCTACCACAAAGCGGCAGAATTGTTGT<br>TGATTACATGGTGCAAAAACCTGGGAAAACAGGAACAATTGTCTAT<br>CAAAGAGGTGTTTTGTTGCCTCAAAAGGTGTGGTGCGCAAGTGGCA<br>GGAGCAAGGTAATAAAAGGGTCCTTGCCTTTAATTGGTGAAGCAGA<br>TTGCCTTCACGAAAAATACGGTGGATTAAACAAAAGCAAGCCTTAC<br>TACACAGGAGAACATGCAAAAGCCATAGGAAATTGCCCAATATGGG<br>TGAAAACACCTTTGAAGCTTGCCAATGGAACCAAATATAGACCTCC<br>TGCAAAACTATTAAAGGAAAGGGGTTTCTTCGGAGCTATTGCTGGT<br>TTCTTAGAGGGAGGATGGGAAGGAATGATTGCAGGTTGGCACGGAT<br>ACACATCTCATGGAGCACATGGAGTGGCAGTGGCAGCAGACCTTAA<br>GAGCACGCAAGAAGCCATAAACAAGATAACAAAAAATCTCAATTCT<br>TTGAGTGAGCTAGAAGTAAAGAATCTTCAAAGACTAAGTGGTGCCA<br>TGGATGAACTCCACAACGAAATACTCGAGCTGGATGAGAAAGTGGA<br>TGATCTCAGAGCTGACACAATAAGCTCGCAAATAGAGCTTGCAGTC<br>TTGCTTTCCAACGAAGGAATAATAAACAGTGAAGATGAGCATCTAT<br>TGGCACTTGAGAGAAAACTAAAGAAAATGCTGGGTCCCTCTGCTGT<br>AGACATAGGGAATGGATGCTTCGAAACCAAACACAAGTGCAACCAG<br>ACCTGCTTAGACAGGATAGCTGCTGGCACCTTTAATGCAGGAGAAT<br>TTTCTCTTCCCACTTTTGATTCACTGAATATTACTGCTGCATCTTT<br>AAATGATGATGGATTGGATAATCATACT | |
| B/Victoria/02/ 1987 mHA | ATGAAGGCAATAATTGTACTACTCATGGTAGTAACATCCAATGCAG<br>ATCGAATCTGCACTGGGATAACATCGTCAAACTCACCCCATGTGGT<br>CAAAACTGCTACTCAAGGGGAAGTCAATGTGACTGGTGTGATACCA<br>CTGACAACAACACCCACCAAATCTCATTTTGCAAATCTCAAAGGAA<br>CAAAAACCAGAGGGAAACTATGCCCAAAGTGTCTCAACTGCACAGA<br>TCTGGACGTGGCCTTGGGCAGACCAAAGTGCACGGGGACCATACCT<br>TCGGCAAAAGCTTCAATACTCCACGAAGTCAAACCTGTTACATCTG<br>GGTGCTTTCCTATAATGCACGACAGAACAAAAATTAGACAGCTACC<br>CAATCTTCTCAGAGGATACGAACATATCAGGTTATCAACCCATAAC<br>GTTATCAACGCAGAAACGGCACCAGGAGGACCCTACAAAGTTGGAA<br>CCTCAGGGTCTTGCCCTAACGTTACCAATGGAAACGGATTCTTCGC<br>AACAATGGCTTGGGCTGTCCCAAAAAACGACAACAACAAAACAGCA<br>ACAAATCCATTAACAGTAGAAGTACCATACATTTGTACAGAAGGAG<br>AAGACCAAATTACTGTTTGGGGGTTCCACTCTGATAACGAAGCCCA<br>AATGGTAAAACTCTATGGAGACTCAAAGCCTCAGAAGTTCACCTCA<br>TCTGCCAACGGAGTGACCACACATTACGTTTCACAGATTGGTGGCT<br>TCCCAAATCAAGCAGAAGACGGAGGGCTACCACAAAGCGGTAGAAT<br>TGTTGTTGATTACATGGTGCAAAAATCTGGAAAAACAGGAACAATT<br>ACCTACCAAAGAGGTATTTTATTGCCTCAAAAAGTGTGGTGCGCAA<br>GTGGCAGGAGCAAGGTAATAAAAGGGTCCTTGCCTTTAATTGGCGA<br>AGCAGATTGCCTCCACGAAAAATACGGTGGATTAAACAAAAGCAAG<br>CCTTACTACACAGGGGAACATGCAAAAGCCATAGGAAATTGCCCAA<br>TATGGGTGAAAACACCCTTGAAGCTGGCCAATGGAACCAAATATAG<br>ACCTCCTGCAAAACTATTAAAGGAAAAGGGTTTCTTCGGAGCTATT<br>GCTGGTTTCTTAGAAGGAGGATGGGAAGGAATGATTGCAGGTTGGC<br>ACGGATACACATCCCATGGAGCACATGGAGTAGCAGTGGCAGCAGA<br>CCTTAAGAGTACGCAAGAAGCCATAAACAAGATAACAAAAAATCTC<br>AATTCTTTGAGTGAGCTGGAAGTAAAGAATCTTCAAAGACTAAGCG<br>GTGCCATGGATGAACTCCACAACAAAATACTCGAACTGGATGAGAA<br>AGTGGATGATCTCAGAGCTGATACAATAAGCTCGCAAATAGAGCTC<br>GCAGTCTTGCTTTCCAACGAAGGAATAATAAACAGTGAAGATGAGC<br>ATCTCTTGGCGCTTGAAAGAAAACTGAAGAAAATGCTGGGCCCCTC<br>TGCTGTAGAGATAGGGAATGGATGCTTCGAAACCAAACACAAGTGC<br>AACCAGACCTGCCTCGACAGAATAGCTGCTGGCACCTTTAATGCAG<br>GAGAATTTTCTCTCCCCACCTTTGATTCACTAAATATTACTGCTGC<br>ATCTTTAAATGATGATGGATTGGATAATCATACTATACTGCTTTAC<br>TACTCAACTGCTGCTTCCAGTTTGGCTGTAACATTGATGATAGCTA<br>TCTTTATTGTTTATATGGTCTCCAGAGACAATGTTTCTTGCTCCAT<br>CTGTCTA | 449 |
| B/Victoria/02/ 1987 sHA | ATGAAGGCAATAATTGTACTACTCATGGTAGTAACATCCAATGCAG<br>ATCGAATCTGCACTGGGATAACATCGTCAAACTCACCCCATGTGGT<br>CAAAACTGCTACTCAAGGGGAAGTCAATGTGACTGGTGTGATACCA<br>CTGACAACAACACCCACCAAATCTCATTTTGCAAATCTCAAAGGAA<br>CAAAAACCAGAGGGAAACTATGCCCAAAGTGTCTCAACTGCACAGA | 450 |

TABLE 18-continued

Influenza Nucleic Acids

| Construct Description | ORF | SEQ ID NO: |
|---|---|---|
| | TCTGGACGTGGCCTTGGGCAGACCAAAGTGCACGGGGACCATACCT<br>TCGGCAAAAGCTTCAATACTCCACGAAGTCAAACCTGTTACATCTG<br>GGTGCTTTCCTATAATGCACGACAGAACAAAAATTAGACAGCTACC<br>CAATCTTCTCAGAGGATACGAACATATCAGGTTATCAACCCATAAC<br>GTTATCAACGCAGAAACGGCACCAGGAGGACCCTACAAAGTTGGAA<br>CCTCAGGGTCTTGCCCTAACGTTACCAATGGAAACGGATTCTTCGC<br>AACAATGGCTTGGGCTGTCCCAAAAAACGACAACAACAAAACAGCA<br>ACAAATCCATTAACAGTAGAAGTACCATACATTTGTACAGAAGGAG<br>AAGACCAAATTACTGTTTGGGGGTTCCACTCTGATAACGAAGCCCA<br>AATGGTAAAACTCTATGGAGACTCAAAGCCTCAGAAGTTCACCTCA<br>TCTGCCAACGGAGTGACCACACATTACGTTTCACAGATTGGTGGCT<br>TCCCAAATCAAGCAGAAGACGGAGGGCTACCACAAAGCGGTAGAAT<br>TGTTGTTGATTACATGGTGCAAAAATCTGGAAAAAGAGGAACAATT<br>ACCTACCAAAGAGGTATTTTATTGCCTCAAAAAGTGTGGTGCGCAA<br>GTGGCAGGAGCAAGGTAATAAAAGGGTCCTTGCCTTTAATTGGCGA<br>AGCAGATTGCCTCCACGAAAAATACGGTGGATTAAACAAAAGCAAG<br>CCTTACTACACAGGGGAACATGCAAAAGCCATAGGAAATTGCCCAA<br>TATGGGTGAAAACACCCTTGAAGCTGGCCAATGGAACCAAATATAG<br>ACCTCCTGCAAAACTATTAAAGGAAAGGGTTTCTTCGGAGCTATT<br>GCTGGTTTCTTAGAAGGAGGATGGGAAGGAATGATTGCAGGTTGGC<br>ACGGATACACATCCCATGGAGCACATGGAGTAGCAGTGGCAGCAGA<br>CCTTAAGAGTACGCAAGAAGCCATAAACAAGATAACAAAAAATCTC<br>AATTCTTTGAGTGAGCTGGAAGTAAAGAATCTTCAAAGACTAAGCG<br>GTGCCATGGATGAACTCCACAACAAAATACTCGAACTGGATGAGAA<br>AGTGGATGATCTCAGAGCTGATACAATAAGCTCGCAAATAGAGCTC<br>GCAGTCTTGCTTTCCAACGAAGGAATAATAAACAGTGAAGATGAGC<br>ATCTCTTGGCGCTTGAAAGAAAACTGAAGAAAATGCTGGGCCCCTC<br>TGCTGTAGAGATAGGGAATGGATGCTTCGAAACCAAACACAAGTGC<br>AACCAGACCTGCCTCGACAGAATAGCTGCTGGCACCTTTAATGCAG<br>GAGAATTTTCTCTCCCCACCTTTGATTCACTAAATATTACTGCTGC<br>ATCTTTAAATGATGATGGATTGGATAATCATACT | |
| B/Brisbane/60/<br>2008 mHA | ATGAAGGCAATAATTGTACTACTCATGGTAGTAACATCCAATGCAG<br>ATCGAATCTGCACTGGGATAACATCGTCAAACTCACCACATGTCGT<br>CAAAACTGCTACTCAAGGGGAGGTCAATGTGACTGGTGTAATACCA<br>CTGACAACAACACCCACCAAATCTCATTTTGCAAATCTCAAAGGAA<br>CAGAAACCAGGGGGAAACTATGCCCAAAATGCCTCAACTGCACAGA<br>TCTGGACGTAGCCTTGGGCAGACCAAAATGCACGGGGAAAATACCC<br>TCGGCAAGAGTTTCAATACTCCATGAAGTCAGACCTGTTACATCTG<br>GGTGCTTTCCTATAATGCACGACAGAACAAAAATTAGACAGCTGCC<br>TAACCTTCTCCGAGGATACGAACATATCAGGTTATCAACCCATAAC<br>GTTATCAATGCAGAAAATGCACCAGGAGGACCCTACAAAATTGGAA<br>CCTCAGGGTCTTGCCCTAACATTACCAATGGAAACGGATTTTTCGC<br>AACAATGGCTTGGGCCGTCCCAAAAAACGACAAAAACAAACAGCA<br>ACAAATCCATTAACAATAGAAGTACCATACATTTGTACAGAAGGAG<br>AAGACCAAATTACCGTTTGGGGGTTCCACTCTGACGACGAGACCCA<br>AATGGCAAAGCTCTATGGGGACTCAAAGCCCCAGAAGTTCACCTCA<br>TCTGCCAACGGAGTGACCACACATTACGTTTCACAGATTGGTGGCT<br>TCCCAAATCAAACAGAAGACGGAGGACTACCACAAAGTGGTAGAAT<br>TGTTGTTGATTACATGGTGCAAAAATCTGGGAAAACAGGAACAATT<br>ACCTATCAAAGGGGTATTTTATTGCCTCAAAAGGTGTGGTGCGCAA<br>GTGGCAGGAGCAAGGTAATAAAAGGATCCTTGCCTTTAATTGGAGA<br>AGCAGATTGCCTCCACGAAAAATACGGTGGATTAAACAAAAGCAAG<br>CCTTACTACACAGGGGAACATGCAAAGGCCATAGGAAATTGCCCAA<br>TATGGGTGAAAACACCCTTGAAGCTGGCCAATGGAACCAAATATAG<br>ACCTCCTGCAAAACTATTAAAGGAAAGGGTTTCTTCGGAGCTATT<br>GCTGGTTTCTTAGAAGGAGGATGGAAGGAATGATTGCAGGTTGGC<br>ACGGATACACATCCCATGGGCACATGGAGTAGCGGTGGCAGCAGA<br>CCTTAAGAGCACTCAAGAGGCCATAAACAAGATAACAAAAAATCTC<br>AACTCTTTGAGTGAGCTGGAAGTAAAGAATCTTCAAAGACTAAGCG<br>GTGCCATGGATGAACTCCACAACGAAATACTAGAACTAGATGAGAA<br>AGTGGATGATCTCAGAGCTGATACAATAAGCTCACAAATAGAACTC<br>GCAGTCCTGCTTTCCAATGAAGGAATAATAAACAGTGAAGATGAAC<br>ATCTCTTGGCGCTTGAAAGAAAGCTGAAGAAAATGCTGGGCCCCTC<br>TGCTGTAGAGATAGGGAATGGATGCTTTGAAACCAAACACAAGTGC<br>AACCAGACCTGTCTCGACAGAATAGCTGCTGGTACCTTTGATGCAG<br>GAGAATTTTCTCTCCCCACCTTTGATTCACTGAATATTACTGCTGC<br>ATCTTTAAATGACGATGGATTGGATAATCATACTATACTGCTTTAC<br>TACTCAACTGCTGCCTCCAGTTTGGCTGTAACACTGATGATAGCTA<br>TCTTTGTTGTTTATATGGTCTCCAGAGACAATGTTTCTTGCTCCAT<br>CTGTCTA | 451 |
| B/Brisbane/60/<br>2008 sHA | ATGAAGGCAATAATTGTACTACTCATGGTAGTAACATCCAATGCAG<br>ATCGAATCTGCACTGGGATAACATCGTCAAACTCACCACATGTCGT<br>CAAAACTGCTACTCAAGGGGAGGTCAATGTGACTGGTGTAATACCA | 452 |

TABLE 18-continued

Influenza Nucleic Acids

| Construct Description | ORF | SEQ ID NO: |
|---|---|---|
| | CTGACAACAACACCCACCAAATCTCATTTTGCAAATCTCAAAGGAA<br>CAGAAACCAGGGGGAAACTATGCCCAAAATGCCTCAACTGCACAGA<br>TCTGGACGTAGCCTTGGGCAGACCAAAATGCACGGGGAAAATACCC<br>TCGGCAAGAGTTTCAATACTCCATGAAGTCAGACCTGTTACATCTG<br>GGTGCTTTCCTATAATGCACGACAGAACAAAAATTAGACAGCTGCC<br>TAACCTTCTCCGAGGATACGAACATATCAGGTTATCAACCCATAAC<br>GTTATCAATGCAGAAAATGCACCAGGAGGACCCTACAAAATTGGAA<br>CCTCAGGGTCTTGCCCTAACATTACCAATGGAAACGGATTTTTCGC<br>AACAATGGCTTGGGCCGTCCCAAAAAACGACAAAAACAAAACAGCA<br>ACAAATCCATTAACAATAGAAGTACCATACATTTGTACAGAAGGAG<br>AAGACCAAATTACCGTTTGGGGGTTCCACTCTGACGACGAGACCCA<br>AATGGCAAAGCTCTATGGGGACTCAAAGCCCCAGAAGTTCACCTCA<br>TCTGCCAACGGAGTGACCACACATTACGTTTCACAGATTGGTGGCT<br>TCCCAAATCAAACAGAAGACGGAGGACTACCACAAAGTGGTAGAAT<br>TGTTGTTGATTACATGGTGCAAAAATCTGGGAAAACAGGAACAATT<br>ACCTATCAAAGGGGTATTTTATTGCCTCAAAAGGTGTGGTGCGCAA<br>GTGGCAGGAGCAAGGTAATAAAAGGATCCTTGCCTTTAATTGGAGA<br>AGCAGATTGCCTCCACGAAAAATACGGTGGATTAAACAAAAGCAAG<br>CCTTACTACACAGGGGAACATGCAAAGGCCATAGGAAATTGCCCAA<br>TATGGGTGAAAACACCCTTGAAGCTGGCCAATGGAACCAAATATAG<br>ACCTCCTGCAAAACTATTAAAGGAAAGGGGTTTCTTCGGAGCTATT<br>GCTGGTTTCTTAGAAGGAGGATGGGAAGGAATGATTGCAGGTTGGC<br>ACGGATACACATCCCATGGGGCACATGGAGTAGCGGTGGCAGCAGA<br>CCTTAAGAGCACTCAAGAGGCCATAAACAAGATAACAAAAAATCTC<br>AACTCTTTGAGTGAGCTGGAAGTAAAGAATCTTCAAAGACTAAGCG<br>GTGCCATGGATGAACTCCACAACGAAATACTAGAACTAGATGAGAA<br>AGTGGATGATCTCAGAGCTGATACAATAAGCTCACAAATAGAACTC<br>GCAGTCCTGCTTTCCAATGAAGGAATAATAAACAGTGAAGATGAAC<br>ATCTCTTGGCGCTTGAAAGAAAGCTGAAGAAAATGCTGGGCCCCTC<br>TGCTGTAGAGATAGGGAATGGATGCTTTGAAACCAAACACAAGTGC<br>AACCAGACCTGTCTCGACAGAATAGCTGCTGGTACCTTTGATGCAG<br>GAGAATTTTCTCTCCCCACCTTTGATTCACTGAATATTACTGCTGC<br>ATCTTTAAATGACGATGGATTGGATAATCATACT | |
| B/Phuket/3073/<br>2013 mHA | ATGAAGGCAATAATTGTACTACTCATGGTAGTAACATCCAATGCAG<br>ATCGAATCTGCACTGGGATAACATCTTCAAACTCACCTCATGTGGT<br>CAAAACAGCTACTCAAGGGGAGGTCAATGTGACTGGCGTGATACCA<br>CTGACAACAACACCAACAAAATCTTATTTTGCAAATCTCAAAGGAA<br>CAAGGACCAGAGGGAAACTATGCCCGGACTGTCTCAACTGTACAGA<br>TCTGGATGTGGCCTTGGGCAGGCCAATGTGTGTGGGGACCACACCT<br>TCTGCTAAAGCTTCAATACTCCACGAGGTCAGACCTGTTACATCCG<br>GGTGCTTTCCTATAATGCACGACAGAACAAAAATCAGGCAACTACC<br>CAATCTTCTCAGAGGATATGAAAAGATCAGGTTATCAACCCAAAAC<br>GTTATCGATGCAGAAAAAGCACCAGGAGGACCCTACAGACTTGGAA<br>CCTCAGGATCTTGCCCTAACGCTACCAGTAAAATCGGATTTTTCGC<br>AACAATGGCTTGGGCTGTCCCAAAGGACAACTACAAAAATGCAACG<br>AACCCACTAACAGTAGAAGTACCATACATTTGTACAGAAGGGGAAG<br>ACCAAATTACTGTTTGGGGGTTCCATTCAGACAACAAAACCCAAAT<br>GAAGAGCCTCTATGGAGACTCAAATCCTCAAAAGTTCACCTCATCT<br>GCTAATGGAGTAACCACACATTATGTTTCTCAGATTGGCGACTTCC<br>CAGATCAAACAGAAGACGGAGGACTACCACAAAGCGGCAGAATTGT<br>TGTTGATTACATGATGCAAAAACCTGGGAAAACAGGAACAATTGTC<br>TATCAAAGAGGTGTTTTGTTGCCTCAAAAGGTGTGGTGCGCGAGTG<br>GCAGGAGCAAAGTAATAAAAGGGTCATTGCCTTTAATTGGTGAAGC<br>AGATTGCCTTCATGAAAAATACGGTGGATTAAACAAAAGCAAGCCT<br>TACTACACAGGAGAACATGCAAAAGCCATAGGAAATTGCCCAATAT<br>GGGTAAAAACACCTTTGAAGCTTGCCAATGGAACCAAATATAGACC<br>TCCTGCAAAACTATTGAAGGAAAGGGGTTTCTTCGGAGCTATTGCT<br>GGTTTCCTAGAAGGAGGATGGGAAGGAATGATTGCAGGTTGGCACG<br>GATACACATCTCACGGAGCACATGGAGTGGCAGTGGCGGCAGACCT<br>TAAGAGTACACAAGAAGCTATAAATAAGATAACAAAAAATCTCAAT<br>TCTTTGAGTGAGCTAGAAGTAAAGAACCTTCAAAGACTAAGTGGTG<br>CCATGGATGAACTCCACAACGAAATACTCGAGCTGGATGAGAAAGT<br>GGATGATCTCAGAGCTGACACTATAAGCTCACAAATAGAACTTGCA<br>GTCTTGCTTTCCAACGAAGGAATAATAAACAGTGAAGACGAGCATC<br>TATTGGCACTTGAGAGAAAACTAAAGAAAATGCTGGGTCCCTCTGC<br>TGTAGACATAGGAAACGGATGCTTCGAAACCAAACACAAATGCAAC<br>CAGACCTGCTTAGACAGGATAGCTGCTGGCACCTTTGATGCAGGAG<br>AATTTTCTCTCCCCACTTTTGATTCATTGAACATTACTGCTGCATC<br>TTTAAATGATGATGGATTGGATAACCATACTATACTGCTCTATTAC | 453 |

TABLE 18-continued

| Influenza Nucleic Acids | | |
|---|---|---|
| Construct Description | ORF | SEQ ID NO: |
| | TCAACTGCTGCTTCTAGTTTGGCTGTAACATTAATGCTAGCTATTT TTATTGTTTATATGGTCTCCAGAGACAACGTTTCATGCTCCATCTG TCTA | |

5'UTR for each construct:
TCAAGCTTTTGGACCCTCGTACAGAAGCTAATACGACTCACTATAGGGAAATAAGAGAGAAAAGAAGA GTAAGAAGAAATATAAGAGCCACC (SEQ ID NO: 445)
3'UTR for each construct:
TGATAATAGGCTGGAGCCTCGGTGGCCATGCTTCTTGCCCCTTGGGCCTCCCCCCAGCCCCTCCTCCC CTTCCTGCACCCGTACCCCCGTGGTCTTTGAATAAAGTCTGAGTGGGCGGC (SEQ ID NO: 446)

It should be understood that the 5' and/or 3' UTR for each construct may be omitted, modified or substituted for a different UTR sequences in any one of the vaccines as provided herein.

TABLE 19

| Examples of Wild Type Hemagglutinin Antigens | | |
|---|---|---|
| Protein/ Strain | Nucleic Acid Sequence | SEQ ID NO: |
| H1 | AGCAAAAGCAGGGGAAAATAAAAACAACCAAAATGAAGGCAAACCTACTG GTCCTGTTATGTGCACTTGCAGCTGCAGATGCAGACACAATATGTATAGG CTACCATGCGAACAATTCAACCGACACTGTTGACACAGTGCTCGAGAAGA ATGTGACAGTGACACACTCTGTTAACCTGCTCGAAGACAGCCACAACGGA AAACTATGTAGATTAAAAGGAATAGCCCCACTACAATTGGGGAAATGTAA CATCGCCGGATGGCTCTTGGGAAACCCAGAATGCGACCCACTGCTTCCAG TGAGATCATGGTCCTACATTGTAGAAACACCAAACTCTGAGAATGGAATA TGTTATCCAGGAGATTTCATCGACTATGAGGAGCTGAGGGAGCAATTGAG CTCAGTGTCATCATTCGAAAGATTCGAAATATTTCCCAAAGAAAGCTCAT GGCCCAACCACAACACAACCAAAGGAGTAACGGCAGCATGCTCCCATGCG GGGAAAAGCAGTTTTTACAGAAATTTGCTATGGCTGACGGAGAAGGAGGG CTCATACCCAAAGCTGAAAAATTCTTATGTGAACAAGAAAGGGAAAGAAG TCCTTGTACTGTGGGGTATTCATCACCCGTCTAACAGTAAGGATCAACAG AATATCTATCAGAATGAAAATGCTTATGTCTCTGTAGTGACTTCAAATTA TAACAGGAGATTTACCCCGGAAATAGCAGAAAGACCCAAAGTAAGAGATC AAGCTGGGAGGATGAACTATTACTGGACCTTGCTAAAACCCGGAGACACA ATAATATTTGAGGCAAATGGAAATCTAATAGCACCAAGGT ATGCTTTCGCACTGAGTAGAGGCTTTGGGTCCGGCATCATCACCTCAAAC GCATCAATGCATGAGTGTAACACGAAGTGTCAAACACCCCTGGGAGCTAT AAACAGCAGTCTCCCTTTCCAGAATATACACCCAGTCACAATAGGAGAGT GCCCAAAATACGTCAGGAGTGCCAAATTGAGGATGGTTACAGGACTAAGG AACATTCCGTCCATTCAATCCAGAGGTCTATTTGGAGCCATTGCCGGTTT TATTGAAGGGGGATGGACTGGAATGATAGATGGATGGTACGGTTATCATC ATCAGAATGAACAGGGATCAGGCTATGCAGCGGATCAAAAAAGCACACAA AATGCCATTAACGGGATTACAAACAAGGTGAACTCTGTTATCGAGAAAAT GAACATTCAATTCACAGCTGTGGGTAAAGAATTCAACAAATTAGAAAAAA GGATGGAAAATTTAAATAAAAAAGTTGATGATGGATTTCTGGACATTTGG ACATATAATGCAGAATTGTTAGTTCTACTGGAAAATGAAAGGACTCTGGA TTTCCATGACTCAAATGTGAAGAATCTGTATGAGAAAGTAAAAAGCCAAT TAAAGAATAATGCCAAAGAAATCGGAAATGGATGTTTTGAGTTCTACCAC AAGTGTGACAATGAATGCATGGAAAGTGTAAGAAATGGGACTTATGATTA TCCCAAATATTCAGAAGAGTCAAAGTTGAACAGGGAAAAGGTAGATGGAG TGAAATTGGAATCAATGGGGATCTATCAGATTCTGGCGATCTACTCAACT GTCGCCAGTTCACTGGTGCTTTTGGTCTCCCTGGGGGCAATCAGTTTCTG GATGTGTTCTAATGGATCTTTGCAGTGCAGAATATGCATCTGAGATTAGA ATTTCAGAAATATGAGGAAAAACACCCTTGTTTCTACT | 454 |
| H7 | AGCGAAAGCAGGGGATACAAAATGAACACTCAAATCCTGGTATTCGCTCT GATTGCGATCATTCCAACAAATGCAGACAAAATCTGCCTCGGACATCATG CCGTGTCAAACGGAACCAAAGTAAACACATTAACTGAAAGAGGAGTGGAA GTCGTCAATGCAACTGAAACAGTGGAACGAACAAACATCCCCAGGATCTG CTCAAAAGGGAAAAGGACAGTTGACCTCGGTCAATGTGGACTCCTGGGGA CAATCACTGGACCACCTCAATGTGACCAATTCCTAGAATTTTCAGCCGAT TTAATTATTGAGAGGCGAGAAGGAAGTGATGTCTGTTATCCTGGGAAATT CGTGAATGAAGAAGCTCTGAGGCAAATTCTCAGAGAATCAGGCGGAATTG ACAAGGAAGCAATGGGATTCACATACAGTGGAATAAGAACTAATGGAGCA ACCAGTGCATGTAGGAGATCAGGATCTTCATTCTATGCAGAAATGAAATG GCTCCTGTCAAACACAGATGATGCTGCATTCCCGCAGATGACTAAGTCAT ATAAAAATACAAGAAAAAGCCCAGCTCTAATAGTATGGGGGATCCATCAT TCCGTATCAACTGCAGAGCAAACCAAGCTATATGGGAGTGGAAACAAACT | 455 |

TABLE 19-continued

| Examples of Wild Type Hemagglutinin Antigens | | |
|---|---|---|
| Protein/ Strain | Nucleic Acid Sequence | SEQ ID NO: |
| | GGTGACAGTTGGGAGTTCTAATTATCAACAATCTTTTGTACCGAGTCCAG GAGCGAGACCACAAGTTAATGGTCTATCTGGAAGAATTGACTTTCATTGG CTAATGCTAAATCCCAATGATACAGTCACTTTCAGTTTCAATGGGGCTTT CATAGCTCCAGACCGTGCAAGCTTCCTGAGAGGAAAATCTATGGGAATCC AGAGTGGAGTACAGGTTGATGCCAATTGTGAAGGGGACTGCTATCATAGT GGAGGGACAATAATAAGTAACTTGCCATTTCAGAACATAGATAGCAGGGC AGTTGGAAAATGTCCGAGATATGTTAAGCAAAGGAGTCTGCTGCTAGCAA CAGGGATGAAGAATGTTCCTGAGATTCCAAAGGGAAGAGGCCTATTTGGT GCTATAGCGGGTTTCATTGAAAATGGATGGGAAGGCCTAATTGATGGTTG GTATGGTTTCAGACACCAGAATGCACAGGGAGAGGGAACTGCTGCAGATT ACAAAAGCACTCAATCGGCAATTGATCAAATAACAGGAAAATTAAACCGG CTTATAGAAAAAACCAACCAACAATTTGAGTTGATAGACAATGAATTCAA TGAGGTAGAGAAGCAAATCGGTAATGTGATAAATTGGACCAGAGATTCTA TAACAGAAGTGTGGTCATACAATGCTGAACTCTTGGTAGCAATGGAGAAC CAGCATACAATTGATCTGGCTGATTCAGAAATGGACAAACTGTACGAACG AGTGAAAAGACAGCTGAGAGAGAATGCTGAAGAAGATGGCACTGGTTGCT TTGAAATATTTCACAAGTGTGATGATGACTGTATGGCCAGTATTAGAAAT AACACCTATGATCACAGCAAATACAGGGAAGAGGCAATGCAAAATAGAAT ACAGATTGACCCAGTCAAACTAAGCAGCGGCTACAAAGATGTGATACTTT GGTTTAGCTTCGGGGCATCATGTTTCATACTTCTAGCCATTGTAATGGGC CTTGTCTTCATATGTGTAAAGAATGGAAACATGCGGTGCACTATTTGTAT ATAAGTTTGGAAAAAAACACCCTTGTTTCTAC | |
| H10 | ATGTACAAAATAGTAGTGATAATCGCGCTCCTTGGAGCTGTGAAAGGTCT TGATAAAATCTGTCTAGGACATCATGCAGTGGCTAATGGGACCATCGTAA AGACTCTCACAAACGAACAGGAAGAGGTAACCAACGCTACTGAAACAGTG GAGAGTACAGGCATAAACAGATTATGTATGAAAGGAAGAAAACATAAAGA CCTGGGCAACTGCCATCCAATAGGGATGCTAATAGGGACTCCAGCTTGTG ATCTGCACCTTACAGGGATGTGGGACACTCTCATTGAACGAGAGAATGCT ATTGCTTACTGCTACCCTGGAGCTACTGTAAATGTAGAAGCACTAAGGCA GAAGATAATGGAGAGTGGAGGGATCAACAAGATAAGCACTGGCTTCACTT ATGGATCTTCCATAAACTCGGCCGGGACCACTAGAGCGTGCATGAGGAAT GGAGGGAATAGCTTTTATGCAGAGCTTAAGTGGCTGGTATCAAAGAGCAA AGGACAAAACTTCCCTCAGACCACGAACACTTACAGAAATACAGACACGG CTGAACACCTCATAATGTGGGGAATTCATCACCCTTCTAGCACTCAAGAG AAGAATGATCTATATGGAACACAATCACTGTCCATATCAGTCGGGAGTTC CACTTACCGGAACAATTTTGTTCCGGTTGTTGGAGCAAGACCTCAGGTCA ATGGACAAAGTGGCAGAATTGATTTTCACTGGACACTAGTACAGCCAGGT GACAACATCACCTTCTCACACAATGGGGGCCTGATAGCACCGAGCCGAGT TAGCAAATTAATTGGGAGGGGATTGGGAATCCAATCAGACGCACCAATAG ACAATAATTGTGAGTCCAAATGTTTTTGGAGAGGGGGTTCTATAAATACA AGGCTTCCCTTTCAAAATTTGTCACCAAGAACAGTGGGTCAGTGTCCTAA ATATGTGAACAGAAGAAGCTTGATGCTTGCAACAGGAATGAGAAACGTAC CAGAACTAATACAAGGGAGAGGTCTATTTGGTGCAATAGCAGGGTTTTTA GAGAATGGGTGGGAAGGAATGGTAGATGGCTGGTATGGTTTCAGACATCA AAATGCTCAGGGCACAGGCCAGGCCGCTGATTACAAGAGTACTCAGGCAG CTATTGATCAAATCACTGGGAAACTGAATAGACTTGTTGAAAAAACCAAT ACTGAGTTCGAGTCAATAGAATCTGAGTTCAGTGAGATCGAACACCAAAT CGGTAACGTCATCAATTGGACTAAGGATTCAATAACCGACATTTGGACTT ATCAGGCTGAGCTGTTGGTGGCAATGGAGAACCAGCATACAATCGACATG GCTGACTCAGAGATGTTGAATCTATATGAAAGAGTGAGGAAACAACTAAG GCAGAATGCAGAAGAAGATGGGAAAGGATGTTTTGAGATATATCATGCTT GTGATGATTCATGCATGGAGAGCATAAGAAACAACACCTATGACCATTCA CAGTACAGAGAGGAAGCTCTTTTGAACAGATTGAATATCAACCCAGTGAC ACTCTCTTCTGGATATAAAGACATCATTCTCTGGTTTAGCTTCGGGGCAT CATGTTTTGTTCTTCTAGCCGTTGTCATGGGTCTTTTCTTTTTCTGTCTG AAGAATGGAAACATGCGATGCACAATCTGTATTTAG | 456 |

TABLE 20

| Additional Flu Constructs | | |
|---|---|---|
| Name | Sequence | SEQ ID NO: |
| MRK_LZ_ NP-H3N2 SQ-031687 CX-003145 | ATGGCCAGCCAGGGCACCAAGAGAAGCTACGAGCAGATGGAG ACCGACGGCGAGAGACAGAACGCCACCGAGATCAGAGCCAGC GTGGGCAAGATGATCGACGGCATCGGCAGATTCTACATCCAGA TGTGCACCGAGCTCAAGCTGAGCGACTACGAGGGCAGACTGAT CCAGAACAGCCTGACCATCGAAAGAATGGTTCTGAGCGCCTTC GACGAGAGAAGAAACAGATACCTGGAGGAGCACCCCAGCGCC GGCAAGGACCCCAAGAAGACCGGCGGCCCCATCTACAAGAGA | 457 |

TABLE 20-continued

Additional Flu Constructs

| Name | Sequence | SEQ ID NO: |
|---|---|---|
| | GTGGACGGCAGATGGATGAGAGAGCTGGTGCTGTACGACAAGG<br>AGGAGATCAGAAGAATCTGGAGACAGGCCAACAACGGCGACG<br>ACGCCACCGCCGGCCTGACCCACATGATGATCTGGCACAGCAA<br>CCTGAACGACACCACCTACCAGAGAACCAGAGCCCTGGTGAGA<br>ACCGGCATGGACCCCAGAATGTGCAGCTTAATGCAGGGCAGCA<br>CCCTGCCCAGAAGATCCGGCGCCGCTGGTGCCGCCGTCAAGGG<br>CATCGGCACCATGGTGATGGAGCTGATCCGCATGATCAAGCGC<br>GGCATCAACGACAGAAACTTCTGGAGAGGCGAAAACGGCAGA<br>AAGACCAGAAGCGCCTACGAGAGAATGTGCAACATCCTGAAGG<br>GCAAGTTCCAGACCGCCGCCCAAAGAGCCATGATGGACCAGGT<br>GAGAGAGAGCAGAAACCCCGGCAACGCCGAGATCGAAGACCT<br>GATCTTCAGCGCCAGATCGGCCCTGATCCTGAGAGGCAGCGTG<br>GCCCACAAGAGCTGCCTGCCCGCCTGCGTGTATGGCCCCGCCGT<br>GAGCAGCGGCTACAACTTCGAGAAGGAGGGCTACAGCCTGGTG<br>GGCATCGACCCCTTCAAGCTGCTGCAGAACTCTCAGGTGTATAG<br>CCTGATCAGACCCAACGAGAACCCCGCCCACAAGAGCCAGCTG<br>GTGTGGATGGCCTGCCACAGCGCCGCCTTCGAGGACCTGAGAC<br>TGCTGAGCTTCATCAGAGGTACCAAGGTGTCCCCAGAGGCAA<br>GCTGAGCACCAGAGGTGCAGATCGCCAGCAATGAGAACATG<br>GACAATATGGAGAGCAGCACCCTGGAGCTAAGAAGCAGGTACT<br>GGGCCATCCGGACCAGAAGCGGCGGCAATACCAACCAGCAGA<br>GAGCCAGCGCCGGCCAGATCAGCGTGCAGCCCACCTTCAGCGT<br>GCAGAGAAACCTGCCCTTTGAGAAGAGCACCGTGATGGCCGCC<br>TTCACCGGCAACACCGAGGGCAGAACCAGCGACATGAGAGCCG<br>AGATCATCAGAATGATGGAGGGCGCCAAGCCCGAGGAGGTGA<br>GCTTTAGAGGCAGAGGCGTGTTCGAGCTGAGCGACGAGAAGGC<br>CACCAACCCAATTGTGCCCAGCTTCGACATGTCGAACGAGGGC<br>AGCTACTTCTTCGGCGACAACGCCGAGGAGTACGACAAC | |
| MRK_LZ_<br>NP-H3N2<br>SQ-031687<br>CX-003145 | MASQGTKRSYEQMETDGERQNATEIRASVGKMIDGIGRFYIQMCT<br>ELKLSDYEGRLIQNSLTIERMVLSAFDERRNRYLEEHPSAGKDPKK<br>TGGPIYKRVDGRWMRELVLYDKEEIRRIWRQANNGDDATAGLTH<br>MMIWHSNLNDTTYQRTRALVRTGMDPRMCSLMQGSTLPRRSGA<br>AGAAVKGIGTMVMELIRMIKRGINDRNFWRGENGRKTRSAYERM<br>CNILKGKFQTAAQRAMMDQVRESRNPGNAEIEDLIFSARSALILRG<br>SVAHKSCLPACVYGPAVSSGYNFEKEGYSLVGIDPFKLLQNSQVY<br>SLIRPNENPAHKSQLVWMACHSAAFEDLRLLSFIRGTKVSPRGKLS<br>TRGVQIASNENMDNMESSTLELRSRYWAIRTRSGGNTNQQRASAG<br>QISVQPTFSVQRNLPFEKSTVMAAFTGNTEGRTSDMRAEIIRMMEG<br>AKPEEVSFRGRGVFELSDEKATNPIVPSFDMSNEGSYFFGDNAEEY<br>DN | 458 |
| MRK_LZ_<br>NIHGen6H<br>ASS-TM2<br>SQ-034074<br>CX-000553 | ATGGAGACCCCCGCCCAGCTGCTGTTCCTGCTGCTGCTGTGGCT<br>GCCCGACACCACCGGCGACACCATCTGCATCGGCTACCACGCC<br>AACAACAGCACCGACACCGTGGACACCGTGCTGGAGAAGAAC<br>GTGACCGTGACCCACAGCGTGAACCTGGGCAGCGGCCTGAGGA<br>TGGTGACCGGCCTGAGGAACATCCCCAGAGGGAGACCAGGGG<br>CCTGTTCGGCGCCATCGCCGGCTTCATCGAGGGCGGCTGGACC<br>GGCATGGTGGACGGCTGGTACGGCTACCACCACCAGAACGAGC<br>AGGGCAGCGGCTACGCCGCCGACCAGAAGAGCACCCAGAACG<br>CCATCAACGGCATCACCAACATGGTGAACAGCGTGATCGAGAA<br>GATGGGCAGCGGCGGCAGCGGCACCGACCTGGCCGAGCTGCTG<br>GTGCTGCTGCTGAACGAGAGGACCCTGGACTTCCACGACAGCA<br>ACGTGAAGAACCTGTACGAGAAGGTGAAGAGCCAGCTGAAGA<br>ACAACGCCAAGGAGATCGGCAACGGCTGCTTCGAGTTCTACCA<br>CAAGTGCAACAACGAGTGCATGGAGAGCGTGAAGAACGGCAC<br>CTACGACTACCCCAAGTACAGCGAGGAGAGCAAGCTGAACAGG<br>GAGAAGATCGACGGAGTGAAATTGGAATCAATGGGGGTCTATC<br>AGATCCTGGCCATCTACAGCACCGTGGCCAGCAGCCTGGTGCT<br>GCTGGTGAGCCTGGGCGCCATCAGCTTCTGGATGTGCAGCAAC<br>GGCAGCCTGCAGTGCAGAATCTGCATC | 459 |
| MRK_LZ_<br>NIHGen6H<br>ASS-TM2<br>SQ-034074<br>CX-000553 | <u>METPAQLLFLLLLWLPDTTGD</u>TICIGYHANNSTDTVDTVLEKNVT<br>VTHSVNLGSGLRMVTGLRNIPQRETRGLFGAIAGFIEGGWTGMVD<br>GWYGYHHQNEQGSGYAADQKSTQNAINGITNMVNSVIEKMGSG<br>GSGTDLAELLVLLLNERTLDFHDSNVKNLYEKVKSQLKNNAKEIG<br>NGCFEFYHKCNNECMESVKNGTYDYPKYSEESKLNREKIDGVKLE<br>SMGVYQILAIYSTVASSLVLLVSLGAISFWMCSNGSLQCRICI | 460 |
| MRK_LZ_<br>NIHGen6H<br>ASS-foldon<br>SQ-032106<br>CX-000596 | ATGGAGACCCCCGCCCAGCTGCTGTTCCTGCTGCTGCTGTGGCT<br>GCCCGACACCACCGGCGACACCATCTGCATCGGCTACCACGCC<br>AACAACAGCACCGACACCGTGGACACCGTGCTGGAGAAGAAC<br>GTGACCGTGACCCACAGCGTGAACCTGGGCAGCGGCCTGAGGA<br>TGGTGACCGGCCTGAGGAACATCCCCAGAGGGAGACCAGGGG<br>CCTGTTCGGCGCCATCGCCGGCTTCATCGAGGGCGGCTGGACC | 461 |

TABLE 20-continued

Additional Flu Constructs

| Name | Sequence | SEQ ID NO: |
|---|---|---|
| | GGCATGGTGGACGGCTGGTACGGCTACCACCACCAGAACGAGC<br>AGGGCAGCGGCTACGCCGCCGACCAGAAGAGCACCCAGAACG<br>CCATCAACGGCATCACCAACATGGTGAACAGCGTGATCGAGAA<br>GATGGGCAGCGGCGGCAGCGGCACCGACCTGGCCGAGCTGCTG<br>GTGCTGCTGCTGAACGAGAGGACCCTGGACTTCCACGACAGCA<br>ACGTGAAGAACCTGTACGAGAAGGTGAAGAGCCAGCTGAAGA<br>ACAACGCCAAGGAGATCGGCAACGGCTGCTTCGAGTTCTACCA<br>CAAGTGCAACAACGAGTGCATGGAGAGCGTGAAGAACGGCAC<br>CTACGACTACCCCAAGTACAGCGAGGAGAGCAAGCTGAACAGG<br>GAGAAGATCGACCCCGGCAGCGGCTACATCCCCGAGGCCCCA<br>GGGACGGCCAGGCCTACGTGAGGAAGGACGGCGAGTGGGTGC<br>TGCTGAGCACCTTCCTG | |
| MRK_LZ_<br>NIHGen6H<br>ASS-foldon<br>SQ-032106<br>CX-000596 | <u>METPAQLLFLLLLWLPDTTGDTICIGYHANNSTDTVDTVLEKNVT</u>VTHSVNLGSGLRMVTGLRNIPQRETRGLFGAIAGFIEGGWTGMVD<br>GWYGYHHQNEQGSGYAADQKSTQNAINGITNMVNSVIEKMGSG<br>GSGTDLAELLVLLLNERTLDFHDSNVKNLYEKVKSQLKNNAKEIG<br>NGCFEFYHKCNNECMESVKNGTYDYPKYSEESKLNREKIDPGSGY<br>IPEAPRDGQAYVRKDGEWVLLSTFL | 462 |

The underlined sequence for each of the amino acid sequences listed in Table 20, indicates a signal or secretory sequence, which may be substituted by an alternative sequence that achieves the same or similar function, or the signal or secretory sequence may be deleted.

TABLE 21

Additional Flu Sequences

| Name | Sequence | SEQ ID NO: |
|---|---|---|
| BHA10-2: HA10 version for Influenza B strain, with exposed hydrophobic residues mutated | METPAQLLFLLLLWLPDTTGHVVKTATQGEVNVT<br>GVIPLTTTPTGSANKSKPYYTGEHAKATGNCPIWV<br>KTPLKLANGTKYGSAGSATQEAINKITKNLNSLSEL<br>EVKNLQRLSGASDETHNEILELDEKVDDLRADTISS<br>QIELAVLLSNEGIINSEDEGTGGGYIPEAPRDGQAY<br>VRKDGEWVLLSTFL | 463 |
| BHA10-3: HA10 version for Influenza B strain, with exposed hydrophobic residues mutated, with K68C/R76C/N95L mutations for trimerization | METPAQLLFLLLLWLPDTTGHVVKTATQGEVNVT<br>GVIPLTTTPTGSANKSKPYYTGEHAKATGNCPIWV<br>KTPLKLANGTKYGSAGSATQEAINKITKNLNSLSEL<br>EVKNLQRLSCASDETHNCILELDEKVDDLRADTISS<br>LIELAVLLSNEGIINSEDE | 464 |
| NIHGen6HASS-TM: Gen6 HA SS construct without foldon or ferritin, with transmembrane domain, version 1 | METPAQLLFLLLLWLPDTTGDTICIGYHANNSTDT<br>VDTVLEKNVTVTHSVNLGSGLRMVTGLRNIPQRET<br>RGLFGAIAGFIEGGWTGMVDGWYGYHHQNEQGS<br>GYAADQKSTQNAINGITNMVNSVIEKMGSGGSGT<br>DLAELLVLLLNERTLDFHDSNVKNLYEKVKSQLK<br>NNAKEIGNCFEFYHKCNNECMESVKNGTYDYPK<br>YSEESKLNREKIDQGTGGILAIYSTVASSLVLLVSL<br>GAISFWMCSNGSLQCRICI | 465 |
| NIHGen6HASS-TM2: Gen6 HA SS construct without foldon or ferritin, with transmembrane domain, version 2 | METPAQLLFLLLLWLPDTTGDTICIGYHANNSTDT<br>VDTVLEKNVTVTHSVNLGSGLRMVTGLRNIPQRET<br>RGLFGAIAGFIEGGWTGMVDGWYGYHHQNEQGS<br>GYAADQKSTQNAINGITNMVNSVIEKMGSGGSGT<br>DLAELLVLLLNERTLDFHDSNVKNLYEKVKSQLK<br>NNAKEIGNCFEFYHKCNNECMESVKNGTYDYPK<br>YSEESKLNREKIDGVKLESMGVYQILAIYSTVASSL<br>VLLVSLGAISFWMCSNGSLQCRICI | 466 |
| H1HA10-PR8-DS-ferritin: H1HA10 from PR8 strain, with additional disulfide mutation, without foldon and with ferritin fusion for particle formation | METPAQLLFLLLLWLPDTTGDTVDTVCEKNVTVT<br>HSVNLLEDSHGSANSSLPYQNTHPTTNGESPKYVR<br>SAKLRMVTGLRNGSAGSATQNAINCITNKVNTVIE<br>KMNIQDTATGKEFNKDEKRMENLNKKVDDGFLDI<br>WTYNAELLVLLENERTLDAHDSQGTGGDIIKLLNE<br>QVNKEMQSSNLYMSMSSWCYTHSLDGAGLFLFD<br>HAAEEYEHAKKLIIFLNENNVPVQLTSISAPEHKFE | 467 |

TABLE 21-continued

Additional Flu Sequences

| Name | Sequence | SEQ ID NO: |
|---|---|---|
| | GLTQIFQKAYEHEQHISESINNIVDHAIKSKDHATF NFLQWYVAEQHEEEVLFKDILDKIELIGNENHGLY LADQYVKGIAKSRKS | |
| ConH1: consensus HA sequence for subtype H1 | MKAKLLVLLCAFTATDADTICIGYHANNSTDTVDT VLEKNVTVTHSVNLLEDSHNGKLCKLKGIAPLQLG KCNIAGWILGNPECESLISKRSWSYIVETPNSENGT CYPGDFADYEELREQLSSVSSFERFEIFPKESSWPN HNVTKGVTAACSHAGKSSFYRNLLWLTEKNGSYP KLSKSYVNNKEKEVLVLWGVHHPSNITDQRTLYQ NENAYVSVVSSHYNRRFTPEIAKRPKVRGQAGRIN YYWTLLEPGDTIIFEANGNLIAPWYAFALSRGFGSG IITSNAPMHECDTKCQTPQGAINSSLPFQNVHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNKLEKRM ENLNKKVDDGFLDIWTYNAELLVLLENERTLDFH DSNVKNLYEKVKSQLKNNAKEIGNGCFEFYHKCN NECMESVKNGTYDYPKYSEESKLNREKIDGVKLES MGVYQILAIYSTVASSLVLLVSLGAISFWMCSNGS LQCRICI | 468 |
| ConH3: consensus HA sequence for subtype H3 | MKTIIALSYIFCLVFAQKLPGNDNSTATLCLGHHAV PNGTLVKTITNDQIEVTNATELVQSSSTGRICDSPH RILDGTNCTLIDALLGDPHCDGFQNKEWDLFVERS KAYSNCYPYDVPDYASLRSLVASSGTLEFNNEGFN WTGVTQNGGSSACKRGSDKSFFSRLNWLHKLKYK YPALNVTMPNNDKFDKLYIWGVHHPSTDSDQTSL YVQASGRVTVSTKRSQQTVIPNIGSRPWVRGLSSRI SIYWTIVKPGDILLINSTGNLIAPRGYFKIRSGKSSIM RSDAPIGTCNSECITPNGSIPNDKPFQNVNRITYGAC PRYVKQNTLKLATGMRNVPEKQTRGIFGAIAGFIE NGWEGMVDGWYGFRHQNSEGTGQAADLKSTQA AIDQINGKLNRLIEKTNEKFHQIEKEFSEVEGRIQDL EKYVEDTKIDLWSYNAELLVALENQHTIDLTDSEM NKLFERTRKQLRENAEDMGNGCFKIYHKCDNACI GSIRNGTYDHDVYRDEALNNRFQIKGVELKSGYK DWILWISFAISCFLLCVVLLGFIMWACQKGNIRCNI CI | 469 |
| MRK_pH1_Con: consensus HA sequence for pandemic H1 strains | MKAILVVLLYTFATANADTLCIGYHANNSTDTVDT VLEKNVTVTHSVNLLEDKHNGKLCKLRGVAPLHL GKCNIAGWILGNPECESLSTASSWSYIVETSSSDNG TCYPGDFIDYEELREQLSSVSSFERFEIFPKTSSWPN HDSNKGVTAACPHAGAKSFYKNLIWLVKKGNSYP KLSKSYINDKGKEVLVLWGIHHPSTSADQQSLYQN ADAYVFVGTSRYSKKFKPEIAIRPKVRDQEGRMNY YWTLVEPGDKITFEATGNLVVPRYAFAMERNAGS GIIISDTPVHDCNTTCQTPKGAINTSLPFQNIHPITIG KCPKYVKSTKLRLATGLRNVPSIQSRGLFGAIAGFI EGGWTGMVDGWYGYHHQNEQGSGYAADLKSTQ NAIDKITNKVNSVIEKMNTQFTAVGKEFNHLEKRIE NLNKKVDDGFLDIWTYNAELLVLLENERTLDYHD SNVKNLYEKVRSQLKNNAKEIGNGCFEFYHKCDN TCMESVKNGTYDYPKYSEEAKLNREEIDGVKLEST RIYQILAIYSTVASSLVLVVSLGAISFWMCSNGSLQ CRICI | 470 |
| MRK_sH1_Con: consensus HA sequence for seasonal H1 strains | MKVKLLVLLCTFTATYADTICIGYHANNSTDTVDT VLEKNVTVTHSVNLLEDSHNGKLCLLKGIAPLQLG NCSVAGWILGNPECELLISKESWSYIVETPNPENGT CYPGYFADYEELREQLSSVSSFERFEIFPKESSWPN HTVTGVSASCSHNGKSSFYRNLLWLTGKNGLYPN LSKSYANNKEKEVLVLWGVHHPPNIGDQRALYHT ENAYVSVVSSHYSRRFTPEIAKRPKVRDQEGRINY YWTLLEPGDTIIFEANGNLIAPRYAFALSRGFGSGII TSNAPMDECDAKCQTPQGAINSSLPFQNVHPVTIG ECPKYVRSAKLRMVTGLRNIPSIQSRGLFGAIAGFI EGGWTGMVDGWYGYHHQNEQGSGYAADQKSTQ NAINGITNKVNSVIEKMNTQFTAVGKEFNKLERRM ENLNKKVDDGFLDIWTYNAELLVLLENERTLDFH DSNVKNLYEKVKSQLKNNAKEIGNGCFEFYHKCN DECMESVKNGTYDYPKYSEESKLNREKIDGVKLES MGVYQILAIYSTVASSLVLLVSLGAISFWMCSNGS LQCRICI | 471 |

TABLE 21-continued

Additional Flu Sequences

| Name | Sequence | SEQ ID NO: |
|---|---|---|
| Cobra_P1: consensus HA sequence P1 for H1 subtype | MKARLLVLLCALAATDADTICIGYHANNSTDTVDT VLEKNVTVTHSVNLLEDSHNGKLCKLKGIAPLQLG KCNIAGWLLGNPECESLLSARSWSYIVETPNSENG TCYPGDFIDYEELREQLSSVSSFERFEIFPKESSWPN HNTTKGVTAACSHAGKSSFYRNLLWLTKKGGSYP KLSKSYVNNKGKEVLVLWGVHHPSTSTDQQSLYQ NENAYVSVVSSNYNRRFTPEIAERPKVRGQAGRM NYYWTLLEPGDTIIFEATGNLIAPWYAFALSRGSGS GIITSNASMHECNTKCQTPQGAINSSLPFQNIHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNNLEKRM ENLNKKVDDGFLDIWTYNAELLVLLENERTLDFH DSNVKNLYEKVKSQLRNNAKEIGNGCFEFYHKCD NECMESVKNGTYDYPKYSEESKLNREKIDGVKLES MGVYQILAIYSTVASSLVLLVSLGAISFWMCSNGS LQCRICI | 472 |
| Cobra_X3: consensus HA sequence X3 for H1 subtype | MEARLLVLLCAFAATNADTICIGYHANNSTDTVDT VLEKNVTVTHSVNLLEDSHNGKLCRLKGIAPLQLG NCSVAGWILGNPECESLFSKESWSYIAETPNPENGT CYPGYFADYEELREQLSSVSSFERFEIFPKESSWPN HTVTKGVTASCSHNGKSSFYRNLLWLTEKNGLYP NLSKSYVNNKEKEVLVLWGVHHPSNIGDQRAIYH TENAYVSVVSSHYSRRFTPEIAKRPKVRDQEGRIN YYWTLLEPGDTIIFEANGNLIAPWYAFALSRGFGSG IITSNASMDECDAKCQTPQGAINSSLPFQNVHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNKLERRM ENLNKKVDDGFLDIWTYNAELLVLLENERTLDFH DSNVKNLYEKVKSQLKNNAKEIGNGCFEFYHKCN NECMESVKNGTYDYPKYSEESKLNREKIDGVKLES MGVYQILAIYSTVASSLVLLVSLGAISFWMCSNGS LQCRICI | 473 |
| ConH1_ferritin: consensus HA sequence for subtype H1, with ferritin for particle formation | MKAKLLVLLCAFTATDADTICIGYHANNSTDTVDT VLEKNVTVTHSVNLLEDSHNGKLCKLKGIAPLQLG KCNIAGWILGNPECESLISKRSWSYIVETPNSENGT CYPGDFADYEELREQLSSVSSFERFEIFPKESSWPN HNVTKGVTAACSHAGKSSFYRNLLWLTEKNGSYP KLSKSYVNNKEKEVLVLWGVHHPSNITDQRTLYQ NENAYVSVVSSHYNRRFTPEIAKRPKVRGQAGRIN YYWTLLEPGDTIIFEANGNLIAPWYAFALSRGFGSG IITSNAPMHECDTKCQTPQGAINSSLPFQNVHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNKLEKRM ENLNKKVDDGFLDIWTYNAELLVLLENERTLDFH DSNVKNLYEKVKSQLKNNAKEIGNGCFEFYHKCN NECMESVKNGTYDYPKYSEESKLNREKIDSGGDII KLLNEQVNKEMQSSNLYMSMSSWCYTHSLDGAG LFLFDHAAEEYEHAKKLIIFLNENNVPVQLTSISAPE HKFEGLTQIFQKAYEHEQHISESINNIVDHAIKSKD HATFNFLQWYVAEQHEEEVLFKDILDKIELIGNEN HGLYLADQYVKGIAKSRKS | 474 |
| ConH3_ferritin: consensus HA sequence for subtype H3, with ferritin for particle formation | MKTIIALSYIFCLVFAQKLPGNDNSTATLCLGHHAV PNGTLVKTITNDQIEVTNATELVQSSSTGRICDSPH RILDGTNCTLIDALLGDPHCDGFQNKEWDLFVERS KAYSNCYPYDVPDYASLRSLVASSGTLEFNNEGRN WTGVTQNGGSSACKRGSDKSFFSRLNWLHKLKYK YPALNVTMPNNDKFDKLYIWGVHHPSTDSDQTSL YVQASGRVTVSTKRSQQTVIPNIGSRPWVRGLSSRI SIYWTIVKPGDILLINSTGNLIAPRGYFKIRSGKSSIM RSDAPIGTCNSECITPNGSIPNDKPFQNVNRITYGAC PRYVKQNTLKLATGMRNVPEKQTRGIFGAIAGFIE NGWEGMVDGWYGFRHQNSEGTGQAADLKSTQA AIDQINGKLNRLIEKTNEKFHQIEKEFSEVEGRIQDL EKYVEDTKIDLWSYNAELLVALENQHTIDLTDSEM NKLFERTRKQLRENAEDMGNGCFKIYHKCDNACI GSIRNGTYDHDVYRDEALNNRFQIKSGGDIKLLNE QVNKEMQSSNLYMSMSSWCYTHSLDGAGLFLFD HAAEEYEHAKKLIIFLNENNVPVQLTSISAPEHKFE | 475 |

TABLE 21-continued

Additional Flu Sequences

| Name | Sequence | SEQ ID NO: |
|---|---|---|
| | GLTQIFQKAYEHEQHISESINNIVDHAIKSKDHATF NFLQWYVAEQHEEEVLFKDILDKIELIGNENHGLY LADQYVKGIAKSRKS | |
| Merck_pH1_Con_ferritin: consensus HA sequence for pandemic H1 strains, with ferritin for particle formation | MKAILVVLLYTFATANADTLCIGYHANNSTDTVDT VLEKNVTVTHSVNLLEDKHNGKLCKLRGVAPLHL GKCNIAGWILGNPECESLSTASSWSYIVETSSSDNG TCYPGDFIDYEELREQLSSVSSFERFEIFPKTSSWPN HDSNKGVTAACPHAGAKSFYKNLIWLVKKGNSYP KLSKSYINDKGKEVLVLWGIHHPSTSADQQSLYQN ADAYVFVGTSRYSKKFKPEIAIRPKVRDQEGRMNY YWTLVEPGDKITFEATGNLVVPRYAFAMERNAGS GIIISDTPVHDCNTTCQTPKGAINTSLPFQNIHPITIG KCPKYVKSTKLRLATGLRNVPSIQSRGLFGAIAGFI EGGWTGMVDGWYGYHHQNEQGSGYAADLKSTQ NAIDKITNKVNSVIEKMNTQFTAVGKEFNHLEKRIE NLNKKVDDGFLDIWTYNAELLVLLENERTLDYHD SNVKNLYEKVRSQLKNNAKEIGNGCFEFYHKCDN TCMESVKNGTYDYPKYSEEAKLNREEIDSGGDIIK LLNEQVNKEMQSSNLYMSMSSWCYTHSLDGAGLF LFDHAAEEYEHAKKLIIFLNENNVPVQLTSISAPEH KFEGLTQIFQKAYEHEQHISESINNIVDHAIKSKDH ATFNFLQWYVAEQHEEEVLFKDILDKIELIGNENH GLYLADQYVKGIAKSRKS | 476 |
| Merck_sH1_Con_ferritin: consensus HA sequence for seasonal H1 strains, with ferritin for particle formation | MKVKLLVLLCTFTATYADTICIGYHANNSTDTVDT VLEKNVTVTHSVNLLEDSHNGKLCLLKGIAPLQLG NCSVAGWILGNPECELLISKESWSYIVETPNPENGT CYPGYFADYEELREQLSSVSSFERFEIFPKESSWPN HTVTGVSASCSHNGKSSFYRNLLWLTGKNGLYPN LSKSYANNKEKEVLVLWGVHHPPNIGDQRALYHT ENAYVSVVSSHYSRRFTPEIAKRPKVRDQEGRINY YWTLLEPGDTIIFEANGNLIAPRYAFALSRGFGSGII TSNAPMDECDAKCQTPQGAINSSLPFQNVHPVTIG ECPKYVRSAKLRMVTGLRNIPSIQSRGLFGAIAGFI EGGWTGMVDGWYGYHHQNEQGSGYAADQKSTQ NAINGITNKVNSVIEKMNTQFTAVGKEFNKLERRM ENLNKKVDDGFLDIWTYNAELLVLLENERTLDFH DSNVKNLYEKVKSQLKNNAKEIGNGCFEFYHKCN DECMESVKNGTYDYPKYSEESKLNREKIDSGGDII KLLNEQVNKEMQSSNLYMSMSSWCYTHSLDGAG LFLFDHAAEEYEHAKKLIIFLNENNVPVQLTSISAPE HKFEGLTQIFQKAYEHEQHISESINNIVDHAIKSKD HATFNFLQWYVAEQHEEEVLFKDILDKIELIGNEN HGLYLADQYVKGIAKSRKS | 477 |
| Cobra_P1_ferritin: consensus HA sequence P1 for H1 subtype, with ferritin for particle formation | MKARLLVLLCALAATDADTICIGYHANNSTDTVDT VLEKNVTVTHSVNLLEDSHNGKLCKLKGIAPLQLG KCNIAGWLLGNPECESLLSARSWSYIVETPNSENG TCYPGDFIDYEELREQLSSVSSFERFEIFPKESSWPN HNTTKGVTAACSHAGKSSFYRNLLWLTKKGGSYP KLSKSYVNNKGKEVLVLWGVHHPSTSTDQQSLYQ NENAYVSVVSSNYNRRFTPEIAERPKVRGQAGRM NYYWTLLEPGDTIIFEATGNLIAPWYAFALSRGSGS GIITSNASMHECNTKCQTPQGAINSSLPFQNIHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNNLEKRM ENLNKKVDDGFLDIWTYNAELLVLLENERTLDFH DSNVKNLYEKVKSQLRNNAKEIGNGCFEFYHKCD NECMESVKNGTYDYPKYSEESKLNREKIDSGGDII KLLNEQVNKEMQSSNLYMSMSSWCYTHSLDGAG LFLFDHAAEEYEHAKKLIIFLNENNVPVQLTSISAPE HKFEGLTQIFQKAYEHEQHISESINNIVDHAIKSKD HATFNFLQWYVAEQHEEEVLFKDILDKIELIGNEN HGLYLADQYVKGIAKSRKS | 478 |
| Cobra_X3_ferritin: consensus HA sequence X3 for H1 subtype, with ferritin for particle formation | MEARLLVLLCAFAATNADTICIGYHANNSTDTVDT VLEKNVTVTHSVNLLEDSHNGKLCRLKGIAPLQLG NCSVAGWILGNPECESLFSKESWSYIAETPNPENGT CYPGYFADYEELREQLSSVSSFERFEIFPKESSWPN HTVTGVTASCSHNGKSSFYRNLLWLTEKNGLYPN LSKSYVNNKEKEVLVLWGVHHPSNIGDQRAIYH TENAYVSVVSSHYSRRFTPEIAKRPKVRDQEGRIN YYWTLLEPGDTIIFEANGNLIAPWYAFALSRGFGSG | 479 |

TABLE 21-continued

Additional Flu Sequences

| Name | Sequence | SEQ ID NO: |
|---|---|---|
| | IITSNASMDECDAKCQTPQGAINSSLPFQNVHPVTI GECPKYVRSTKLRMVTGLRNIPSIQSRGLFGAIAGF IEGGWTGMIDGWYGYHHQNEQGSGYAADQKSTQ NAINGITNKVNSVIEKMNTQFTAVGKEFNKLERRM ENLNKKVDDGFLDIWTYNAELLVLLENERTLDFH DSNVKNLYEKVKSQLKNNAKEIGNGCFEFYHKCN NECMESVKNGTYDYPKYSEESKLNREKIDSGGDII KLLNEQVNKEMQSSNLYMSMSSWCYTHSLDGAG LFLFDHAAEEYEHAKKLIIFLNENNVPVQLTSISAPE HKFEGLTQIFQKAYEHEQHISESINNIVDHAIKSKD HATFNFLQWYVAEQHEEEVLFKDILDKIELIGNEN HGLYLADQYVKGIAKSRKS | |

TABLE 22

Signal Peptides

| Description | Sequence | SEQ ID NO: |
|---|---|---|
| HuIgG$_k$ signal peptide | METPAQLLFLLLLWLPDTTG | 480 |
| IgE heavy chain epsilon -1 signal peptide | MDWTWILFLVAAATRVHS | 481 |
| Japanese encephalitis PRM signal sequence | MLGSNSGQRVVFTILLLLVAPAYS | 482 |
| VSVg protein signal sequence | MKCLLYLAFLFIGVNCA | 483 |
| Japanese encephalitis JEV signal sequence | MWLVSLAIVTACAGA | 484 |

TABLE 23

Flagellin Nucleic Acid Sequences

| Name | Sequence | SEQ ID NO: |
|---|---|---|
| NT (5' UTR, ORF, 3' UTR) | TCAAGCTTTTGGACCCTCGTACAGAAGCTAATACGACTCA CTATAGGGAAATAAGAGAGAAAAGAAGAGTAAGAAGAA ATATAAGAGCCACCATGGCACAAGTCATTAATACAAACA GCCTGTCGCTGTTGACCCAGAATAACCTGAACAAATCCC AGTCCGCACTGGGCACTGCTATCGAGCGTTTGTCTTCCGG TCTGCGTATCAACAGCGCGAAAGACGATGCGGCAGGACA GGCGATTGCTAACCGTTTTACCGCGAACATCAAAGGTCT GACTCAGGCTTCCCGTAACGCTAACGACGGTATCTCCATT GCGCAGACCACTGAAGGCGCGCTGAACGAAATCAACAAC AACCTGCAGCGTGTGCGTGAACTGGCGGTTCAGTCTGCG AATGGTACTAACTCCCAGTCTGACCTCGACTCCATCCAGG CTGAAATCACCCAGCGCCTGAACGAAATCGACCGTGTAT CCGGCCAGACTCAGTTCAACGGCGTGAAAGTCCTGGCGC AGGACAACACCCTGACCATCCAGGTTGGTGCCAACGACG GTGAAACTATCGATATTGATTTAAAAGAAATCAGCTCTA AAACACTGGGACTTGATAAGCTTAATGTCCAAGATGCCT ACACCCCGAAAGAAACTGCTGTAACCGTTGATAAAACTA CCTATAAAAATGGTACAGATCCTATTACAGCCCAGAGCA ATACTGATATCCAAACTGCAATTGGCGGTGGTGCAACGG GGGTTACTGGGGCTGATATCAAATTTAAAGATGGTCAAT ACTATTTAGATGTTAAAGGCGGTGCTTCTGCTGGTGTTTA TAAAGCCACTTATGATGAAACTACAAAGAAAGTTAATAT TGATACGACTGATAAAACTCCGTTGGCAACTGCGGAAGC TACAGCTATTCGGGGAACGGCCACTATAACCCACAACCA AATTGCTGAAGTAACAAAAGAGGGTGTTGATACGACCAC AGTTGCGGCTCAACTTGCTGCAGCAGGGGTTACTGGCGC CGATAAGGACAATACTAGCCTTGTAAAACTATCGTTTGA GGATAAAAACGGTAAGGTTATTGATGGTGGCTATGCAGT GAAAATGGGCGACGATTTCTATGCCGCTACATATGATGA GAAAACAGGTGCAATTACTGCTAAAACCACTACTTATAC AGATGGTACTGGCGTTGCTCAAACTGGAGCTGTGAAATT TGGTGGCGCAAATGGTAAATCTGAAGTTGTTACTGCTACC GATGGTAAGACTTACTTAGCAAGCGACCTTGACAAACAT AACTTCAGAACAGGCGGTGAGCTTAAAGAGGTTAATACA | 485 |

TABLE 23-continued

Flagellin Nucleic Acid Sequences

| Name | Sequence | SEQ ID NO: |
|---|---|---|
| | GATAAGACTGAAAACCCACTGCAGAAAATTGATGCTGCC<br>TTGGCACAGGTTGATACACTTCGTTCTGACCTGGGTGCGG<br>TTCAGAACCGTTTCAACTCCGCTATCACCAACCTGGGCAA<br>TACCGTAAATAACCTGTCTTCTGCCCGTAGCCGTATCGAA<br>GATTCCGACTACGCAACCGAAGTCTCCAACATGTCTCGC<br>GCGCAGATTCTGCAGCAGGCCGGTACCTCCGTTCTGGCG<br>CAGGCGAACCAGGTTCCGCAAAACGTCCTCTCTTTACTGC<br>GTTGATAATAGGCTGGAGCCTCGGTGGCCATGCTTCTTGC<br>CCCTTGGGCCTCCCCCCAGCCCCTCCTCCCCTTCCTGCAC<br>CCGTACCCCCGTGGTCTTTGAATAAAGTCTGAGTGGGCG<br>GC | |
| ORF Sequence, NT | ATGGCACAAGTCATTAATACAAACAGCCTGTCGCTGTTG<br>ACCCAGAATAACCTGAACAAATCCCAGTCCGCACTGGGC<br>ACTGCTATCGAGCGTTTGTCTTCCGGTCTGCGTATCAACA<br>GCGCGAAAGACGATGCGGCAGGACAGGCCGATTGCTAACC<br>GTTTTACCGCGAACATCAAAGGTCTGACTCAGGCTTCCCG<br>TAACGCTAACGACGGTATCTCCATTGCGCAGACCACTGA<br>AGGCGCGCTGAACGAAATCAACAACAACCTGCAGCGTGT<br>GCGTGAACTGGCGGTTCAGTCTGCGAATGGTACTAACTC<br>CCAGTCTGACCTCGACTCCATCCAGGCTGAAATCACCCA<br>GCGCCTGAACGAAATCGACCGTGTATCCGGCCAGACTCA<br>GTTCAACGGCGTGAAAGTCCTGGCGCAGGACAACACCCT<br>GACCATCCAGGTTGGTGCCAACGACGGTGAAACTATCGA<br>TATTGATTTAAAAGAAATCAGCTCTAAAACACTGGGACT<br>TGATAAGCTTAATGTCCAAGATGCCTACACCCCGAAAGA<br>AACTGCTGTAACCGTTGATAAAACTACCTATAAAAATGG<br>TACAGATCCTATTACAGCCCAGAGCAATACTGATATCCA<br>AACTGCAATTGGCGGTGGTGCAACGGGGGTTACTGGGGC<br>TGATATCAAATTTAAAGATGGTCAATACTATTTAGATGTT<br>AAAGGCGGTGCTTCTGCTGGTGTTTATAAAGCCACTTATG<br>ATGAAACTACAAAGAAAGTTAATATTGATACGACTGATA<br>AAACTCCGTTGGCAACTGCGGAAGCTACAGCTATTCGGG<br>GAACGGCCACTATAACCCACAACCAAATTGCTGAAGTAA<br>CAAAAGAGGGTGTTGATACGACCACAGTTGCGGCTCAAC<br>TTGCTGCAGCAGGGGTTACTGGCGCCGATAAGGACAATA<br>CTAGCCTTGTAAAACTATCGTTTGAGGATAAAAACGGTA<br>AGGTTATTGATGGTGGCTATGCAGTGAAAATGGGCGACG<br>ATTTCTATGCCGCTACATATGATGAGAAAACAGGTGCAA<br>TTACTGCTAAAACCACTACTTATACAGATGGTACTGGCGT<br>TGCTCAAACTGGAGCTGTGAAATTTGGTGGCGCAAATGG<br>TAAATCTGAAGTTGTTACTGCTACCGATGGTAAGACTTAC<br>TTAGCAAGCGACCTTGACAAACATAACTTCAGAACAGGC<br>GGTGAGCTTAAAGAGGTTAATACAGATAAGACTGAAAAC<br>CCACTGCAGAAAATTGATGCTGCCTTGGCACAGGTTGAT<br>ACACTTCGTTCTGACCTGGGTGCGGTTCAGAACCGTTTCA<br>ACTCCGCTATCACCAACCTGGGCAATACCGTAAATAACC<br>TGTCTTCTGCCCGTAGCCGTATCGAAGATTCCGACTACGC<br>AACCGAAGTCTCCAACATGTCTCGCGCGCAGATTCTGCA<br>GCAGGCCGGTACCTCCGTTCTGGCGCAGGCGAACCAGGT<br>TCCGCAAAACGTCCTCTCTTTACTGCGT | 486 |
| mRNA Sequence (assumes T100 tail) | G*<u>GGGAAAUAAGAGAGAAAAGAAGAGUAAGAAGAAAU<br>AUAAGAGCCACC</u>AUGGCACAAGUCAUUAAUACAAACAG<br>CCUGUCGCUGUUGACCCAGAAUAACCUGAACAAAUCCC<br>AGUCCGCACUGGGCACUGCUAUCGAGCGUUUGUCUUCC<br>GGUCUGCGUAUCAACAGCGCGAAAGACGAUGCGGCAGG<br>ACAGGCGAUUGCUAACCGUUUUACCGCGAACAUCAAAG<br>GUCUGACUCAGGCUUCCCGUAACGCUAACGACGGUAUC<br>UCCAUUGCGCAGACCACUGAAGGCGCGCUGAACGAAAU<br>CAACAACAACCUGCAGCGUGUGCGUGAACUGGCGGUUC<br>AGUCUGCGAAUGGUACUAACUCCCAGUCUGACCUCGAC<br>UCCAUCCAGGCUGAAAUCACCCAGCGCCUGAACGAAAU<br>CGACCGUGUAUCCGGCCAGACUCAGUUCAACGGCGUGA<br>AAGUCCUGGCGCAGGACAACACCCUGACCAUCCAGGUU<br>GGUGCCAACGACGGUGAAACUAUCGAUAUUGAUUUAAA<br>AGAAAUCAGCUCUAAAACACUGGGACUUGAUAAGCUUA<br>AUGUCCAAGAUGCCUACACCCCGAAAGAAACUGCUGUA<br>ACCGUUGAUAAAACUACCUAUAAAAAUGGUACAGAUCC<br>UAUUACAGCCCAGAGCAAUACUGAUAUCCAAACUGCAA<br>UUGGCGGUGGUGCAACGGGGGUUACUGGGGCUGAUAUC<br>AAAUUUAAAGAUGGUCAAUACUAUUUAGAUGUUAAAG<br>GCGGUGCUUCUGCUGGUGUUUAUAAAGCCACUUAUGAU<br>GAAACUACAAAGAAAGUUAAUAUUGAUACGACUGAUA<br>AAACUCCGUUGGCAACUGCGGAAGCUACAGCUAUUCGG | 487 |

TABLE 23-continued

Flagellin Nucleic Acid Sequences

| Name | Sequence | SEQ ID NO: |
|------|----------|-----------|
|  | GGAACGGCCACUAUAACCCACAACCAAAUUGCUGAAGU<br>AACAAAAGAGGGUGUUGAUACGACCACAGUUGCGGCUC<br>AACUUGCUGCAGCAGGGGUUACUGGCGCCGAUAAGGAC<br>AAUACUAGCCUUGUAAAACUAUCGUUUGAGGAUAAAAA<br>CGGUAAGGUUAUUGAUGGUGGCUAUGCAGUGAAAAUG<br>GGCGACGAUUUCUAUGCCGCUACAUAUGAUGAGAAAAC<br>AGGUGCAAUUACUGCUAAAACCACUACUUAUACAGAUG<br>GUACUGGCGUUGCUCAAACUGGAGCUGUGAAAUUUGGU<br>GGCGCAAAUGGUAAAUCUGAAGUUGUUACUGCUACCGA<br>UGGUAAGACUUACUUAGCAAGCGACCUUGACAAACAUA<br>ACUUCAGAACAGGCGGUGAGCUUAAAGAGGUUAAUACA<br>GAUAAGACUGAAAACCCACUGCAGAAAAUUGAUGCUGC<br>CUUGGCACAGGUUGAUACACUUCGUUCUGACCUGGGUG<br>CGGUUCAGAACCGUUUCAACUCCGCUAUCACCAACCUG<br>GGCAAUACCGUAAAUAACCUGUCUUCUGCCCGUAGCCG<br>UAUCGAAGAUUCCGACUACGCAACCGAAGUCUCCAACA<br>UGUCUCGCGCGCAGAUUCUGCAGCAGGCCGGUACCUCC<br>GUUCUGGCGCAGGCGAACCAGGUUCCGCAAAACGUCCU<br>CUCUUUACUGCGUUGAUAAUAGGCUGGAGCCUCGGUGG<br>CCAUGCUUCUUGCCCCUUGGGCCUCCCCCCAGCCCUCC<br>UCCCCUUCCUGCACCCGUACCCCGUGGGUCUUUGAAUA<br>AGUCUGAGUGGGCGGCAAAAAAAAAAAAAAAAAAAA<br>AAAAAAAAAAAAAAAAAAAAAAAAAAAAAAAAAAA<br>AAAAAAAAAAAAAAAAAAAAAAAAAAAAAAAAAAA<br>AAAAAAUCUAG |  |

The first underlined sequence is representative of the 5' UTR, which may be included in or omitted from any of the constructs listed in Table 1, or it may be modified or substituted with another 5' UTR comprising a different sequence.

The second underlined sequence is representative of the 3' UTR, which may be included in or omitted from any of the constructs listed in Table 1, or it may be modified or substituted with another 3' UTR comprising a different sequence.

TABLE 24

Flagellin Amino Acid Sequences

| Name | Sequence | SEQ ID NO: |
|------|----------|-----------|
| ORF Sequence, AA | MAQVINTNSLSLLTQNNLNKSQSAL<br>GTAIERLSSGLRINSAKDDAAGQAI<br>ANRFTANIKGLTQASRNANDGISIA<br>QTTEGALNEINNNLQRVRELAVQSA<br>NGTNSQSDLDSIQAEITQRLNEIDR<br>VSGQTQFNGVKVLAQDNTLTIQVGA<br>NDGETIDIDLKEISSKTLGLDKLNV<br>QDAYTPKETAVTVDKTTYKNGTDPI<br>TAQSNTDIQTAIGGGATPGVTGADIK<br>FKDGQYYLDVKGGASAGVYKATYDE<br>TTKKVNIDTTDKTPLATAEATAIRG<br>TATITHNQIAEVTKEGVDTTTVAAQ<br>LAAAGVTGADKDNTSLVKLSFEDKN<br>GKVIDGGYAVKMGDDFYAATYDEKT<br>GAITAKTTTYTDGTGVAQTGAVKFG<br>GANGKSEVVTATDGKTYLASDLDKH<br>NFRTGGELKEVNTDKTENPLQKIDA<br>ALAQVDTLRSDLGAVQNRFNSAITN<br>LGNTVNNLSSARSRIEDSDYATEVS<br>NMSRAQILQQAGTSVLAQANQVPQN<br>VLSLLR | 488 |
| Flagellin-GS linker-circumsporozoite protein (CSP) | MAQVINTNSLSLLTQNNLNKSQSAL<br>GTAIERLSSGLRINSAKDDAAGQAI<br>ANRFTANIKGLTQASRNANDGISIA<br>QTTEGALNEINNNLQRVRELAVQSA<br>NSTNSQSDLDSIQAEITQRLNEIDR<br>VSGQTQFNGVKVLAQDNTLTIQVGA<br>NDGETIDIDLKQINSQTLGLDTLNV<br>QQKYKVSDTAATVTGYADTTIALDN<br>STFKASATGLGGTDQKIDGDLKFDD<br>TTGKYYAKVTVTGGTGKDGYYEVSV<br>DKTNGEVTLAGGATSPLTGGLPATA<br>TEDVKNVQVANADLTEAKAALTAAG<br>VTGTASVVKMSYTDNNGKTIDGGLA<br>VKVGDDYYSATQNKDGSISINTTKY<br>TADDGTSKTALNKLGGADGKTEVVS<br>IGGKTYAASKAEGHNFKAQPDLAEA<br>AATTTENPLQKIDAALAQVDTLRSD<br>LGAVQNRFNSAITNLGNTVNNLTSA<br>RSRIEDSDYATEVSNMSRAQILQQA<br>GTSVLAQANQVPQNVLSLLRGGGGS<br>GGGGSMMAPDPNANPNANPNANPNA<br>NPNANPNANPNANPNANPNANPNAN<br>PNANPNANPNANPNANPNANPNANP<br>NANPNANPNANPNKNNQGNGQGHNM<br>PNDPNRNVDENANANNAVKNNNNEE<br>PSDKHIEQYLKKIKNSISTEWSPCS<br>VTCGNGIQVRIKPGSANKPKDELDY<br>ENDIEKKICKMEKCSSVFNVVNS | 489 |
| Flagellin-RPVT linker-circumsporozoite protein (CSP) | MMAPDPNANPNANPNANPNANPNAN<br>PNANPNANPNANPNANPNANPNANP<br>NANPNANPNANPNANPNANPNANPN<br>ANPNANPNKNNQGNGQGHNMPNDPN<br>RNVDENANANNAVKNNNNEEPSDKH<br>IEQYLKKIKNSISTEWSPCSVTCGN<br>GIQVRIKPGSANKPKDELDYENDIE<br>KKICKMEKCSSVFNVVNSRPVTMAQ<br>VINTNSLSLLTQNNLNKSQSALGTA<br>IERLSSGLRINSAKDDAAGQAIANR<br>FTANIKGLTQASRNANDGISIAQTT<br>EGALNEINNNLQRVRELAVQSANST<br>NSQSDLDSIQAEITQRLNEIDRVSG<br>QTQFNGVKVLAQDNTLTIQVGANDG | 490 |

TABLE 24-continued

Flagellin Amino Acid Sequences

| Name | Sequence | SEQ ID NO: |
|---|---|---|
| | ETIDIDLKQINSQTLGLDTLNVQQK YKVSDTAATVTGYADTTIALDNSTF KASATGLGGTDQKIDGDLKFDDTTG KYYAKVTVTGGTGKDGYYEVSVDKT NGEVTLAGGATSPLTGGLPATATED VKNVQVANADLTEAKAALTAAGVTG TASVVKMSYTDNNGKTIDGGLAVKV GDDYYSATQNKDGSISINTTKYTAD DGTSKTALNKLGGADGKTEVVSIGG KTYAASKAEGHNFKAQPDLAEAAAT TTENPLQKIDAALAQVDTLRSDLGA VQNRFNSAITNLGNTVNNLTSARSR IEDSDYATEVSNMSRAQILQQAGTS VLAQANQVPQNVLSLLR | |

TABLE 25

Influenza mRNA Constructs
Influenza mRNA Sequences

| Construct Description | ORF | SEQ ID NO: |
|---|---|---|
| B/Yamagata/16/ 1988 mHA | AUGAAGGCAAUAAUUGUACUACUCAUGGUAGUAACAUC CAACGCAGAUCGAAUCUGCACUGGGAUAACAUCUUCAAA CUCACCUCAUGUGGUCAAAACAGCUACUCAAGGGAAGU UAAUGUGACUGGUGUGAUACCACUGACAACAACACCAAC AAAAUCUCAUUUUGCAAAUCUCAAAGGAACAAAGACCA GAGGGAAACUAUGCCCAAACUGUCUCAACUGCACAGAUC UGGAUGUGGCCUUGGGCAGACCAAUGUGUAUGGGGACC AUACCUUCGGCAAAAGCUUCAAUACUCCACGAAGUCAGA CCUGUUACAUCCGGGUGCUUUCCUAUAAUGCACGACAGA ACAAAAAUCAGACAGCUACCCAAUCUUCUCAGAGGAUAU GAAAAUAUCAGAUUAUCAACCCAUAACGUUAUCAACGC AGAAAGGGCACCAGGAGGACCCUACAGACUUGGAACCUC AGGAUCUUGCCCUAACGUUACCAGUAGAAACGGAUUCU UCGCAACAAUGGCUUGGGCUGUCCCAAGGGACAACAAAA CAGCGAAUCCACUAACAGUAGAAGUACCAUACAUUU GCACAAAAGGAGAAGACCAAAUUACUGUUUGGGGGUUC CAUUCUGAUGACAAAACCCAAAUGAAAAACCUCUAUGG AGACUCAAAUCCUCAAAAGUUCACCUCAUCUGCCAAUGG AGUAACCACACAUUAUGUUUCUCAGAUUGGUGACUUCCC AAAUCAAACAGAAGACGGAGGGCUACCACAAAGCGGCA GAAUUGUUGUUGAUUACAUGGUGCAAAAACCUGGGAAA ACAGGAACAAUUGUCUAUCAAAGAGGUGUUUUGUUGCC UCAAAAGGUGUGGUGCGCAAGUGGCAGGAGCAAGGUAA UAAAAGGGUCCUUGCCUUUAAUUGGUGAAGCAGAUUGC CUUCACGAAAAAUACGGUGGAUUAAACAAAAGCAAGCC UUACUACACAGGAGAACAUGCAAAAGCCAUAGGAAAUU GCCCAAUAUGGGUGAAAACACCUUUGAAGCUUGCCAAU GGAACCAAAUAUAGACCUCCUGCAAAACUAUUAAAGGA AAGGGGUUUCUUCGGAGCUAUUGCUGGUUUCUUAGAGG GAGGAUGGGAAGGAAUGAUUGCAGGUUGGCACGGAUAC ACAUCUCAUGGAGCACAUGGAGUGGCAGUGGCAGCAGA CCUUAAGAGCACGCAAGAAGCCAUAAACAAGAUAACAA AAAAUCUCAAUUCUUUGAGUGAGCUAGAAGUAAAGAAU CUUCAAAGACUAAGUGGUGCCAUGGAUGAACUCCACAAC GAAAUACUCGAGCUGGAUGAGAAAGUGGAUGAUCUCAG AGCUGACACAAUAAGCUCGCAAAUAGAGCUUGCAGUCU UGCUUUCCAACGAAGGAAUAAUAAACAGUGAAGAUGAG CAUCUAUUGGCACUUGAGAGAAAACUAAAGAAAAUGCU GGGUCCCUCUGCUGUAGACAUAGGGAAUGGAUGCUUCG AAACCAAACACAAGUGCAACCAGACCUGCUUAGACAGGA UAGCUGCUGGCACCUUUAAUGCAGGAGAAUUUUCUCUU CCCACUUUUGAUUCACUGAAUAUUACUGCUGCAUCUUUA AAUGAUGAUGGAUUGGAUAAUCAUACUAUACUGCUCUA CUACUCAACUGCUGCUUCUAGUUUGGCCGUAACAUUGAU GAUAGCUAUUUUUAUUGUUUAUAUGGUCUCCAGAGACA AUGUUUCUUGCUCCAUCUGUCUA | 491 |
| B/Yamagata/16/ 1988 sHA | AUGAAGGCAAUAAUUGUACUACUCAUGGUAGUAACAUC CAACGCAGAUCGAAUCUGCACUGGGAUAACAUCUUCAAA CUCACCUCAUGUGGUCAAAACAGCUACUCAAGGGAAGU UAAUGUGACUGGUGUGAUACCACUGACAACAACACCAAC AAAAUCUCAUUUUGCAAAUCUCAAAGGAACAAAGACCA GAGGGAAACUAUGCCCAAACUGUCUCAACUGCACAGAUC UGGAUGUGGCCUUGGGCAGACCAAUGUGUAUGGGGACC AUACCUUCGGCAAAAGCUUCAAUACUCCACGAAGUCAGA CCUGUUACAUCCGGGUGCUUUCCUAUAAUGCACGACAGA | 492 |

TABLE 25-continued

Influenza mRNA Constructs
Influenza mRNA Sequences

| Construct Description | ORF | SEQ ID NO: |
|---|---|---|
| | ACAAAAAUCAGACAGCUACCCAAUCUUCUCAGAGGAUAU GAAAAUAUCAGAUUAUCAACCCAUAACGUUAUCAACGC AGAAAGGGCACCAGGAGGACCCUACAGACUUGGAACCUC AGGAUCUUGCCCUAACGUUACCAGUAGAAACGGAUUCU UCGCAACAAUGGCUUGGGCUGUCCCAAGGGACAACAAAA CAGCAACGAAUCCACUAACAGUAGAAGUACCAUACAUUU GCACAAAAGGAGAAGACCAAAUUACUGUUUGGGGGUUC CAUUCUGAUGACAAAACCCAAAUGAAAAACCUCUAUGG AGACUCAAAUCCUCAAAAGUUCACCUCAUCUGCCAAUGG AGUAACCACACAUUAUGUUUCUCAGAUUGGUGACUUCCC AAAUCAAACAGAAGACGGAGGGCUACCACAAAGCGGCA GAAUUGUUGUUGAUUACAUGGUGCAAAAACCUGGGAAA ACAGGAACAAUUGUCUAUCAAAGAGGUGUUUUGUUGCC UCAAAAGGUGUGGUGCGCAAGUGGCAGGAGCAAGGUAA UAAAAGGGUCCUUGCCUUUAAUUGGUGAAGCAGAUUGC CUUCACGAAAAAUACGGUGGAUUAAACAAAAGCAAGCC UUACUACACAGGAGAACAUGCAAAAGCCAUAGGAAAUU GCCCAAUAUGGGUGAAAACACCUUUGAAGCUUGCCAAU GGAACCAAAUAUAGACCUCCUGCAAAACUAUUAAAGGA AAGGGGUUUCUUCGGAGCUAUUGCUGGUUUCUUAGAGG GAGGAUGGGAAGGAAUGAUUGCAGGUUGGCACGGAUAC ACAUCUCAUGGAGCACAUGGAGUGGCAGUGGCAGCAGA CCUUAAGAGCACGCAAGAAGCCAUAAACAAGAUAACAA AAAAUCUCAAUUCUUUGAGUGAGCUAGAAGUAAAGAAU CUUCAAAGACUAAGUGGUGCCAUGGAUGAACUCCACAAC GAAAUACUCGAGCUGGAUGAGAAAGUGGAUGAUCUCAG AGCUGACACAAUAAGCUCGCAAAUAGAGCUUGCAGUCU UGCUUUCCAACGAAGGAAUAAUAAACAGUGAAGAUGAG CAUCUAUUGGCACUUGAGAGAAAACUAAAGAAAAUGCU GGGUCCCUCUGCUGUAGACAUAGGGAAUGGAUGCUUCG AAACCAAACACAAGUGCAACCAGACCUGCUUAGACAGGA UAGCUGCUGGCACCUUUAAUGCAGGAGAAUUUUCUCUU CCCACUUUUGAUUCACUGAAUAUUACUGCUGCAUCUUUA AAUGAUGAUGGAUUGGAUAAUCAUACU | |
| B/Victoria/02/ 1987 mHA | AUGAAGGCAAUAAUUGUACUACUCAUGGUAGUAACAUC CAAUGCAGAUCGAAUCUGCACUGGGAUAACAUCGUCAA ACUCACCCCAUGUGGUCAAAACUGCUACUCAAGGGGAAG UCAAUGUGACUGGUGUGAUACCACUGACAACAACACCCA CCAAAUCUCAUUUUGCAAAUCUCAAAGGAACAAAAACCA GAGGGAAACUAUGCCCAAAGUGUCUCAACUGCACAGAUC UGGACGUGGCCUUGGGCAGACCAAAGUGCACGGGGACCA UACCUUCGGCAAAAGCUUCAAUACUCCACGAAGUCAAAC CUGUUACAUCUGGGUGCUUUCCUAUAAUGCACGACAGA ACAAAAAUUAGACAGCUACCCAAUCUUCUCAGAGGAUAC GAACAUAUCAGGUUAUCAACCCAUAACGUUAUCAACGCA GAAACGGCACCAGGAGGACCCUACAAAGUUGGAACCUCA GGGUCUUGCCCUAACGUUACCAAUGGAAACGGAUUCUUC GCAACAAUGGCUUGGGCUGUCCCAAAAAACGACAACAAC AAAACAGCAACAAAUCCAUUAACAGUAGAAGUACCAUA CAUUUGUACAGAAGGAGAAGACCAAAUUACUGUUUGGG GGUUCCACUCUGAUAACGAAGCCCAAAUGGUAAAACUCU AUGGAGACUCAAAGCCUCAGAAGUUCACCUCAUCUGCCA ACGGAGUGACCACACAUUACGUUUCACAGAUUGGUGGC UUCCCAAAUCAAGCAGAAGACGGAGGGCUACCACAAAGC GGUAGAAUUGUUGUUGAUUACAUGGUGCAAAAAUCUGG AAAAACAGGAACAAUUACCUACCAAAGAGGUAUUUUAU UGCCUCAAAAAGUGUGGUGCGCAAGUGGCAGGAGCAAG GUAAUAAAAGGGUCCUUGCCUUUAAUUGGCGAAGCAGA UUGCCUCCACGAAAAAUACGGUGGAUUAAACAAAAGCA AGCCUUACUACACAGGGGAACAUGCAAAAGCCAUAGGA AAUUGCCCAAUAUGGGUGAAAACACCCUUGAAGCUGGCC AAUGGAACCAAAUAUAGACCUCCUGCAAAACUAUUAAA GGAAAAGGGUUUCUUCGGAGCUAUUGCUGGUUUCUUAG AAGGAGGAUGGGAAGGAAUGAUUGCAGGUUGGCACGGA UACACAUCCCAUGGAGCACAUGGAGUAGCAGUGGCAGCA GACCUUAAGAGUACGCAAGAAGCCAUAAACAAGAUAAC AAAAAAUCUCAAUUCUUUGAGUGAGCUGGAAGUAAAGA AUCUUCAAAGACUAAGCGGUGCCAUGGAUGAACUCCACA ACAAAAUACUCGAACUGGAUGAGAAAGUGGAUGAUCUC AGAGCUGAUACAAUAAGCUCGCAAAUAGAGCUCGCAGU CUUGCUUUCCAACGAAGGAAUAAUAAACAGUGAAGAUG AGCAUCUCUUGGCGCUUGAAAGAAAACUGAAGAAAAUG CUGGGCCCCUCUGCUGUAGAGAUAGGGAAUGGAUGCUU | 493 |

TABLE 25-continued

Influenza mRNA Constructs
Influenza mRNA Sequences

| Construct Description | ORF | SEQ ID NO: |
|---|---|---|
| | CGAAACCAAACACAAGUGCAACCAGACCUGCCUCGACAG AAUAGCUGCUGGCACCUUUAAUGCAGGAGAAUUUUCUC UCCCCACCUUUGAUUCACUAAAUAUUACUGCUGCAUCUU UAAAUGAUGAUGGAUUGGAUAAUCAUACUAUACUGCUU UACUACUCAACUGCUGCUUCCAGUUUGGCUGUAACAUUG AUGAUAGCUAUCUUUAUUGUUUAUAUGGUCUCCAGAGA CAAUGUUUCUUGCUCCAUCUGUCUA | |
| B/Victoria/02/ 1987 sHA | AUGAAGGCAAUAAUUGUACUACUCAUGGUAGUAACAUC CAAUGCAGAUCGAAUCUGCACUGGGAUAACAUCGUCAA ACUCACCCCAUGUGGUCAAAACUGCUACUCAAGGGGAAG UCAAUGUGACUGGUGUGAUACCACUGACAACAACACCCA CCAAAUCUCAUUUUGCAAAUCUCAAAGGAACAAAAACCA GAGGGAAACUAUGCCCAAAGUGUCUCAACUGCACAGAUC UGGACGUGGCCUUGGGCAGACCAAAGUGCACGGGGACCA UACCUUCGGCAAAAGCUUCAAUACUCCACGAAGUCAAAC CUGUUACAUCUGGGUGCUUUCCUAUAAUGCACGACAGA ACAAAAAUUAGACAGCUACCCAAUCUUCUCAGAGGAUAC GAACAUAUCAGGUUAUCAACCCAUAACGUUAUCAACGCA GAAACGGCACCAGGAGGACCCUACAAAGUUGGAACCUCA GGGUCUUGCCCUAACGUUACCAAUGGAAACGGAUUCUUC GCAACAAUGGCUUGGGCUGUCCCAAAAAACGACAACAAC AAAACAGCAACAAAUCCAUUAACAGUAGAAGUACCAUA CAUUUGUACAGAAGGAGAAGACCAAAUUACUGUUUGGG GGUUCCACUCUGAUAACGAAGCCCAAAUGGUAAAACUCU AUGGAGACUCAAAGCCUCAGAAGUUCACCUCAUCUGCCA ACGGAGUGACCACACAUUACGUUUCACAGAUUGGUGGC UUCCCAAAUCAAGCAGAAGACGGAGGGCUACCACAAAGC GGUAGAAUUGUUGUUGAUUACAUGGUGCAAAAAUCUGG AAAAACAGGAACAAUUACCUACCAAAGAGGUAUUUUAU UGCCUCAAAAAGUGUGGUGCGCAAGUGGCAGGAGCAAG GUAAUAAAAGGGUCCUUGCCUUUAAUUGGCAAGCAGA UUGCCUCCACGAAAAAUACGGUGGAUUAAACAAAAGCA AGCCUUACUACACAGGGGAACAUGCAAAAGCCAUAGGA AAUUGCCCAAUAUGGGUGAAAACACCCUUGAAGCUGGCC AAUGGAACCAAAUAUAGACCUCCUGCAAAACUAUUAAA GGAAAAGGGUUUCUUCGGAGCUAUUGCUGGUUUCUUAG AAGGAGGAUGGGAAGGAAUGAUUGCAGGUUGGCACGGA UACACAUCCCAUGGAGCACAUGGAGUAGCAGUGGCAGCA GACCUUAAGAGUACGCAAGAAGCCAUAAACAAGAUAAC AAAAAAUCUCAAUUCUUUGAGUGAGCUGGAAGUAAAGA AUCUUCAAAGACUAAGCGGUGCCAUGGAUGAACUCCACA ACAAAAUACUCGAACUGGAUGAGAAAGUGGAUGAUCUC AGAGCUGAUACAAUAAGCUCGCAAAUAGAGCUCGCAGU CUUGCUUUCCAACGAAGGAAUAAUAAACAGUGAAGAUG AGCAUCUCUUGGCGCUUGAAAGAAAACUGAAGAAAAUG CUGGGCCCCUCUGCUGUAGAGAUAGGGAAUGGAUGCUU CGAAACCAAACACAAGUGCAACCAGACCUGCCUCGACAG AAUAGCUGCUGGCACCUUUAAUGCAGGAGAAUUUUCUC UCCCCACCUUUGAUUCACUAAAUAUUACUGCUGCAUCUU UAAAUGAUGAUGGAUUGGAUAAUCAUACU | 494 |
| B/Brisbane/60/ 2008 mHA | AUGAAGGCAAUAAUUGUACUACUCAUGGUAGUAACAUC CAAUGCAGAUCGAAUCUGCACUGGGAUAACAUCGUCAA ACUCACCACAUGUCGUCAAAACUGCUACUCAAGGGGAGG UCAAUGUGACUGGUGUAAUACCACUGACAACAACACCCA CCAAAUCUCAUUUUGCAAAUCUCAAAGGAACAGAAACCA GGGGGAAACUAUGCCCAAAAUGCCUCAACUGCACAGAUC UGGACGUAGCCUUGGGCAGACCAAAAUGCACGGGGAAA AUACCCUCGGCAAGAGUUUCAAUACUCCAUGAAGUCAGA CCUGUUACAUCUGGGUGCUUUCCUAUAAUGCACGACAGA ACAAAAAUUAGACAGCUGCCUAACCUUCUCCGAGGAUAC GAACAUAUCAGGUUAUCAACCCAUAACGUUAUCAUGC AGAAAAUGCACCAGGAGGACCCUACAAAAUUGGAACCUC AGGGUCUUGCCCUAACAUUACCAAUGGAAACGGAUUUU UCGCAACAAUGGCUUGGGCCGUCCCAAAAAACGACAAAA ACAAAACAGCAACAAAUCCAUUAACAAUAGAAGUACCA UACAUUUGUACAGAAGGAGAAGACCAAAUUACCGUUUG GGGGUUCCACUCUGACGACGAGACCCAAAUGGCAAAGCU CUAUGGGGACUCAAAGCCCCAGAAGUUCACCUCAUCUGC CAACGGAGUGACCACACAUUACGUUUCACAGAUUGGUG GCUUCCCAAAUCAAACAGAAGACGGAGGACUACCACAAA GUGGUAGAAUUGUUGUUGAUUACAUGGUGCAAAAAUCU GGGAAAACAGGAACAAUUACCUAUCAAAGGGGUAUUUU | 495 |

TABLE 25-continued

Influenza mRNA Constructs
Influenza mRNA Sequences

| Construct Description | ORF | SEQ ID NO: |
|---|---|---|
| | AUUGCCUCAAAAGGUGUGGUGCGCAAGUGGCAGGAGCA AGGUAAUAAAAGGAUCCUUGCCUUUAAUUGGAGAAGCA GAUUGCCUCCACGAAAAAUACGGUGGAUUAAACAAAAG CAAGCCUUACUACACAGGGGAACAUGCAAAGGCCAUAGG AAAUUGCCCAAUAUGGGUGAAAACACCCUUGAAGCUGG CCAAUGGAACCAAAUAUAGACCUCCUGCAAAACUAUUAA AGGAAAGGGGUUUCUUCGGAGCUAUUGCUGGUUUCUUA GAAGGAGGAUGGGAAGGAAUGAUUGCAGGUUGGCACGG AUACACAUCCCAUGGGGCACAUGGAGUAGCGGUGGCAGC AGACCUUAAGAGCACUCAAGAGGCCAUAAACAAGAUAA CAAAAAAUCUCAACUCUUUGAGUGAGCUGGAAGUAAAG AAUCUUCAAAGACUAAGCGGUGCCAUGGAUGAACUCCAC AACGAAAUACUAGAACUAGAUGAGAAAGUGGAUGAUCU CAGAGCUGAUACAAUAAGCUCACAAAUAGAACUCGCAG UCCUGCUUUCCAAUGAAGGAAUAAUAAACAGUGAAGAU GAACAUCUCUUGGCGCUUGAAAGAAAGCUGAAGAAAAU GCUGGGCCCCUCUGCUGUAGAGAUAGGGAAUGGAUGCU UUGAAACCAAACACAAGUGCAACCAGACCUGUCUCGACA GAAUAGCUGCUGGUACCUUUGAUGCAGGAGAAUUUUCU CUCCCCACCUUUGAUUCACUGAAUAUUACUGCUGCAUCU UUAAAUGACGAUGGAUUGGAUAAUCAUACUAUACUGCU UUACUACUCAACUGCUGCCUCCAGUUUGGCUGUAACACU GAUGAUAGCUAUCUUUGUUGUUUAUAUGGUCUCCAGAG ACAAUGUUUCUUGCUCCAUCUGUCUA | |
| B/Brisbane/60/ 2008 sHA | AUGAAGGCAAUAAUUGUACUACUCAUGGUAGUAACAUC CAAUGCAGAUCGAAUCUGCACUGGGAUAACAUCGUCAA ACUCACCACAUGUCGUCAAAACUGCUACUCAAGGGGAGG UCAAUGUGACUGGUGUAAUACCACUGACAACAACACCCA CCAAAUCUCAUUUUGCAAAUCUCAAAGGAACAGAAACCA GGGGGAAACUAUGCCCAAAAUGCCUCAACUGCACAGAUC UGGACGUAGCCUUGGGCAGACCAAAAUGCACGGGGAAA AUACCCUCGGCAAGAGUUUCAAUACUCCAUGAAGUCAGA CCUGUUACAUCUGGGUGCUUUCCUAUAAUGCACGACAGA ACAAAAAUUAGACAGCUGCCUAACCUUCUCCGAGGAUAC GAACAUAUCAGGUUAUCAACCCAUAACGUUAUCAAUGC AGAAAAUGCACCAGGAGGACCCUACAAAAUUGGAACCUC AGGGUCUUGCCCUAACAUUACCAAUGGAAACGGAUUUU UCGCAACAAUGGCUUGGGCCGUCCCAAAAAACGACAAAA ACAAAACAGCAACAAAUCCAUUAACAAUAGAAGUACCA UACAUUUGUACAGAAGGAGAAGACCAAAUUACCGUUUG GGGGUUCCACUCUGACGACGAGACCCAAAUGGCAAAGCU CUAUGGGGACUCAAAGCCCCAGAAGUUCACCUCAUCUGC CAACGGAGUGACCACACAUUACGUUUCACAGAUUGGUG GCUUCCCAAAUCAAACAGAAGACGGAGGACUACCACAAA GUGGUAGAAUUGUUGUUGAUUACAUGGUGCAAAAAUCU GGGAAAACAGGAACAAUUACCUAUCAAAGGGGUAUUUU AUUGCCUCAAAAGGUGUGGUGCGCAAGUGGCAGGAGCA AGGUAAUAAAAGGAUCCUUGCCUUUAAUUGGAGAAGCA GAUUGCCUCCACGAAAAAUACGGUGGAUUAAACAAAAG CAAGCCUUACUACACAGGGGAACAUGCAAAGGCCAUAGG AAAUUGCCCAAUAUGGGUGAAAACACCCUUGAAGCUGG CCAAUGGAACCAAAUAUAGACCUCCUGCAAAACUAUUAA AGGAAAGGGGUUUCUUCGGAGCUAUUGCUGGUUUCUUA GAAGGAGGAUGGGAAGGAAUGAUUGCAGGUUGGCACGG AUACACAUCCCAUGGGGCACAUGGAGUAGCGGUGGCAGC AGACCUUAAGAGCACUCAAGAGGCCAUAAACAAGAUAA CAAAAAAUCUCAACUCUUUGAGUGAGCUGGAAGUAAAG AAUCUUCAAAGACUAAGCGGUGCCAUGGAUGAACUCCAC AACGAAAUACUAGAACUAGAUGAGAAAGUGGAUGAUCU CAGAGCUGAUACAAUAAGCUCACAAAUAGAACUCGCAG UCCUGCUUUCCAAUGAAGGAAUAAUAAACAGUGAAGAU GAACAUCUCUUGGCGCUUGAAAGAAAGCUGAAGAAAAU GCUGGGCCCCUCUGCUGUAGAGAUAGGGAAUGGAUGCU UUGAAACCAAACACAAGUGCAACCAGACCUGUCUCGACA GAAUAGCUGCUGGUACCUUUGAUGCAGGAGAAUUUUCU CUCCCCACCUUUGAUUCACUGAAUAUUACUGCUGCAUCU UUAAAUGACGAUGGAUUGGAUAAUCAUACU | 496 |
| B/Phuket/3073/ 2013 mHA | AUGAAGGCAAUAAUUGUACUACUCAUGGUAGUAACAUC CAAUGCAGAUCGAAUCUGCACUGGGAUAACAUCUUCAA ACUCACCUCAUGUGGUCAAAACAGCUACUCAAGGGGAGG UCAAUGUGACUGGCGUGAUACCACUGACAACAACACCAA CAAAAUCUUAUUUUGCAAAUCUCAAAGGAACAAGGACC | 497 |

TABLE 25-continued

Influenza mRNA Constructs
Influenza mRNA Sequences

| Construct Description | ORF | SEQ ID NO: |
|---|---|---|
| | AGAGGGAAACUAUGCCCGGACUGUCUCAACUGUACAGA UCUGGAUGUGGCCUUGGGCAGGCCAAUGUGUGUGGGGA CCACACCUUCUGCUAAAGCUUCAAUACUCCACGAGGUCA GACCUGUUACAUCCGGGUGCUUUCCUAUAAUGCACGACA GAACAAAAAUCAGGCAACUACCCAAUCUUCUCAGAGGAU AUGAAAAGAUCAGGUUAUCAACCCAAAACGUUAUCGAU GCAGAAAAAGCACCAGGAGGACCCUACAGACUUGGAACC UCAGGAUCUUGCCCUAACGCUACCAGUAAAAUCGGAUUU UUCGCAACAAUGGCUUGGGCUGUCCCAAAGGACAACUAC AAAAAUGCAACGAACCCACUAACAGUAGAAGUACCAUAC AUUUGUACAGAAGGGGAAGACCAAAUUACUGUUUGGGG GUUCCAUUCAGACAACAAAACCCAAAUGAAGAGCCUCUA UGGAGACUCAAAUCCUCAAAAGUUCACCUCAUCUGCUAA UGGAGUAACCACACAUUAUGUUUCUCAGAUUGGCGACU UCCCAGAUCAAACAGAAGACGGAGGACUACCACAAAGCG GCAGAAUUGUUGUUGAUUACAUGAUGCAAAAACCUGGG AAAACAGGAACAAUUGUCUAUCAAAGAGGUGUUUUGUU GCCUCAAAAGGUGUGGUGCGCGAGUGGCAGGAGCAAAG UAAUAAAAGGGUCAUUGCCUUUAAUUGGUGAAGCAGAU UGCCUUCAUGAAAAAUACGGUGGAUUAAACAAAAGCAA GCCUUACUACACAGGAGAACAUGCAAAAGCCAUAGGAA AUUGCCCAAUAUGGGUAAAAACACCUUUGAAGCUUGCC AAUGGAACCAAAUAUAGACCUCCUGCAAAACUAUUGAA GGAAAGGGGUUUCUUCGGAGCUAUUGCUGGUUUCCUAG AAGGAGGAUGGGAAGGAAUGAUUGCAGGUUGGCACGGA UACACAUCUCACGGAGCACAUGGAGUGGCAGUGGCGGCA GACCUUAAGAGUACACAAGAAGCUAUAAAUAAGAUAAC AAAAAAUCUCAAUUCUUUGAGUGAGCUAGAAGUAAAGA ACCUUCAAAGACUAAGUGGUGCCAUGGAUGAACUCCACA ACGAAAUACUCGAGCUGGAUGAGAAAGUGGAUGAUCUC AGAGCUGACACUAUAAGCUCACAAAUAGAACUUGCAGU CUUGCUUUCCAACGAAGGAAUAAUAAACAGUGAAGACG AGCAUCUAUUGGCACUUGAGAGAAAACUAAAGAAAAUG CUGGGUCCCUCUGCUGUAGACAUAGGAAACGGAUGCUUC GAAACCAAACACAAAUGCAACCAGACCUGCUUAGACAGG AUAGCUGCUGGCACCUUUGAUGCAGGAGAAUUUUCUCU CCCCACUUUUGAUUCAUUGAACAUUACUGCUGCAUCUUU AAAUGAUGAUGGAUUGGAUAACCAUACUAUACUGCUCU AUUACUCAACUGCUGCUUCUAGUUUGGCUGUAACAUUA AUGCUAGCUAUUUUUAUUGUUUAUAUGGUCUCCAGAGA CAACGUUUCAUGCUCCAUCUGUCUA | |
| H1 | AGCAAAAGCAGGGGAAAAUAAAAACAACCAAAAUGAAG GCAAACCUACUGGUCCUGUUAUGUGCACUUGCAGCUGCA GAUGCAGACACAAUAUGUAUAGGCUACCAUGCGAACAA UUCAACCGACACUGUUGACACAGUGCUCGAGAAGAAUG UGACAGUGACACACUCUGUUAACCUGCUCGAAGACAGCC ACAACGGAAAACUAUGUAGAUUAAAAGGAAUAGCCCCA CUACAAUUGGGGAAAUGUAACAUCGCCGGAUGGCUCUU GGGAAACCCAGAAUGCGACCCACUGCUUCCAGUGAGAUC AUGGUCCUACAUUGUAGAAACACCAAACUCUGAGAAUG GAAUAUGUUAUCCAGGAGAUUUCAUCGACUAUGAGGAG CUGAGGGAGCAAUUGAGCUCAGUGUCAUCAUUCGAAAG AUUCGAAAUAUUUCCCAAAGAAAGCUCAUGGCCCAACCA CAACACAACCAAAGGAGUAACGGCAGCAUGCUCCCAUGC GGGGAAAAGCAGUUUUUACAGAAAUUUGCUAUGGCUGA CGGAGAAGGAGGGCUCAUACCCAAAGCUGAAAAAUUCU UAUGUGAACAAGAAAGGGAAAGAAGUCCUUGUACUGUG GGGUAUUCAUCACCCGUCUAACAGUAAGGAUCAACAGA AUAUCUAUCAGAAUGAAAAUGCUUAUGUCUCUGUAGUG ACUUCAAAUUAUAACAGGAGAUUUACCCCGGAAAUAGC AGAAAGACCCAAAGUAAGAGAUCAAGCUGGGAGGAUGA ACUAUUACUGGACCUUGCUAAAACCCGGAGACACAAUAA UAUUUGAGGCAAAUGGAAAUCUAAUAGCACCAAGGU AUGCUUUCGCACUGAGUAGAGGCUUUGGGUCCGGCAUC AUCACCUCAAACGCAUCAAUGCAUGAGUGUAACACGAAG UGUCAAACACCCCUGGGAGCUAUAAACAGCAGUCUCCCU UUCCAGAAUAUACACCCAGUCACAAUAGGAGAGUGCCCA AAAUACGUCAGGAGUGCCAAAUUGAGGAUGGUUACAGG ACUAAGGAACAUUCCGUCCAUUCAAUCCAGAGGUCUAUU UGGAGCCAUUGCCGGUUUUAUUGAAGGGGGAUGGACUG GAAUGAUAGAUGGAUGGUACGGUUAUCAUCAUCAGAAU GAACAGGGAUCAGGCUAUGCAGCGGAUCAAAAAAGCAC ACAAAAUGCCAUUAACGGGAUUACAAACAAGGUGAACU | 498 |

TABLE 25-continued

Influenza mRNA Constructs
Influenza mRNA Sequences

| Construct Description | ORF | SEQ ID NO: |
|---|---|---|
| | CUGUUAUCGAGAAAAUGAACAUUCAAUUCACAGCUGUG GGUAAAGAAUUCAACAAAUUAGAAAAAAGGAUGGAAAA UUUAAAUAAAAAAGUUGAUGAUGGAUUUCUGGACAUUU GGACAUAUAAUGCAGAAUUGUUAGUUCUACUGGAAAAU GAAAGGACUCUGGAUUUCCAUGACUCAAAUGUGAAGAA UCUGUAUGAGAAAGUAAAAAGCCAAUUAAAGAAUAAUG CCAAAGAAAUCGGAAAUGGAUGUUUUGAGUUCUACCAC AAGUGUGACAAUGAAUGCAUGGAAAGUGUAAGAAAUGG GACUUAUGAUUAUCCCAAAUAUUCAGAAGAGUCAAAGU UGAACAGGGAAAAGGUAGAUGGAGUGAAAUUGGAAUCA AUGGGGAUCUAUCAGAUUCUGGCGAUCUACUCAACUGU CGCCAGUUCACUGGUGCUUUUGGUCUCCCUGGGGGCAAU CAGUUUCUGGAUGUGUUCUAAUGGAUCUUUGCAGUGCA GAAUAUGCAUCUGAGAUUAGAAUUUCAGAAAUAUGAGG AAAAACACCCUUGUUUCUACU | |
| H7 | AGCGAAAGCAGGGGAUACAAAAUGAACACUCAAAUCCU GGUAUUCGCUCUGAUUGCGAUCAUUCCAACAAAUGCAG ACAAAAUCUGCCUCGGACAUCAUGCCGUGUCAAACGGAA CCAAAGUAAACACAUUAACUGAAAGAGGAGUGGAAGUC GUCAAUGCAACUGAAACAGUGGAACGAACAAACAUCCCC AGGAUCUGCUCAAAAGGGAAAAGGACAGUUGACCUCGG UCAAUGUGGACUCCUGGGGACAAUCACUGGACCACCUCA AUGUGACCAAUUCCUAGAAUUUUCAGCCGAUUUAAUUA UUGAGAGGCGAGAAGGAAGUGAUGUCUGUUAUCCUGGG AAAUUCGUGAAUGAAGAAGCUCUGAGGCAAAUUCUCAG AGAAUCAGGCGGAAUUGACAAGGAAGCAAUGGGAUUCA CAUACAGUGGAAUAAGAACUAAUGGAGCAACCAGUGCA UGUAGGAGAUCAGGAUCUUCAUUCUAUGCAGAAAUGAA AUGGCUCCUGUCAAACACAGAUGAUGCUGCAUUCCCGCA GAUGACUAAGUCAUAUAAAAAUACAAGAAAAAGCCCAG CUCUAAUAGUAUGGGGGAUCCAUCAUUCCGUAUCAACU GCAGAGCAAACCAAGCUAUAUGGGAGUGGAAACAAACU GGUGACAGUUGGGAGUUCUAAUUAUCAACAAUCUUUUG UACCGAGUCCAGGAGCGAGACCACAAGUUAAUGGUCUA UCUGGAAGAAUUGACUUUCAUUGGCUAAUGCUAAAUCC CAAUGAUACAGUCACUUUCAGUUUCAAUGGGGCUUUCA UAGCUCCAGACCGUGCAAGCUUCCUGAGAGGAAAAUCUA UGGGAAUCCAGAGUGGAGUACAGGUUGAUGCCAAUUGU GAAGGGGACUGCUAUCAUAGUGGAGGGACAAUAAUAAG UAACUUGCCAUUUCAGAACAUAGAUAGCAGGGCAGUUG GAAAAUGUCCGAGAUAUGUUAAGCAAAGGAGUCUGCUG CUAGCAACAGGGAUGAAGAAUGUUCCUGAGAUUCCAAA GGGAAGAGGCCUAUUUGGUGCUAUAGCGGGUUUCAUUG AAAAUGGAUGGGAAGGCCUAAUUGAUGGUUGGUAUGGU UUCAGACACCAGAAUGCACAGGGAGAGGGAACUGCUGC AGAUUACAAAAGCACUCAAUCGGCAAUUGAUCAAAUAA CAGGAAAAUUAAACCGGCUUAUAGAAAAAACCAACCAA CAAUUUGAGUUGAUAGACAAUGAAUUCAAUGAGGUAGA GAAGCAAAUCGGUAAUGUGAUAAAUUGGACCAGAGAUU CUAUAACAGAAGUGUGGUCAUACAAUGCUGAACUCUUG GUAGCAAUGGAGAACCAGCAUACAAUUGAUCUGGCUGA UUCAGAAAUGGACAAACUGUACGAACGAGUGAAAAGAC AGCUGAGAGAGAAUGCUGAAGAAGAUGGCACUGGUUGC UUUGAAAUAUUUCACAAGUGUGAUGAUGACUGUAUGGC CAGUAUUAGAAAUAACACCUAUGAUCACAGCAAAUACA GGGAAGAGGCAAUGCAAAAUAGAAUACAGAUUGACCCA GUCAAACUAAGCAGCGGCUACAAAGAUGUGAUACUUUG GUUUAGCUUCGGGGCAUCAUGUUUCAUACUUCUAGCCA UUGUAAUGGGCCUUGUCUUCAUAUGUGUAAAGAAUGGA AACAUGCGGUGCACUAUUUGUAUAUAAGUUUGGAAAAA AACACCCUUGUUUCUAC | 499 |
| H10 | AUGUACAAAAUAGUAGUGAUAAUCGCGCUCCUUGGAGC UGUGAAAGGUCUUGAUAAAAUCUGUCUAGGACAUCAUG CAGUGGCUAAUGGGACCAUCGUAAAGACUCUCACAAACG AACAGGAAGAGGUAACCAACGCUACUGAAACAGUGGAG AGUACAGGCAUAAACAGAUUAUGUAUGAAAGGAAGAAA ACAUAAAGACCUGGGCAACUGCCAUCCAAUAGGGAUGCU AAUAGGGACUCCAGCUUGUGAUCUGCACCUUACAGGGA UGUGGGACACUCUCAUUGAACGAGAGAAUGCUAUUGCU UACUGCUACCCUGGAGCUACUGUAAAUGUAGAAGCACU AAGGCAGAAGAUAAUGGAGAGUGGAGGGAUCAACAAGA UAAGCACUGGCUUCACUUAUGGAUCUUCCAUAAACUCGG | 500 |

TABLE 25-continued

Influenza mRNA Constructs
Influenza mRNA Sequences

| Construct Description | ORF | SEQ ID NO: |
|---|---|---|
| | CCGGGACCACUAGAGCGUGCAUGAGGAAUGGAGGGAAU<br>AGCUUUUAUGCAGAGCUUAAGUGGCUGGUAUCAAAGAG<br>CAAAGGACAAAACUUCCCUCAGACCACGAACACUUACAG<br>AAAUACAGACACGGCUGAACACCUCAUAAUGUGGGGAA<br>UUCAUCACCCUUCUAGCACUCAAGAGAAGAAUGAUCUAU<br>AUGGAACACAAUCACUGUCCAUAUCAGUCGGGAGUUCCA<br>CUUACCGGAACAAUUUUGUUCCGGUUGUUGGAGCAAGA<br>CCUCAGGUCAAUGGACAAAGUGGCAGAAUUGAUUUUCA<br>CUGGACACUAGUACAGCCAGGUGACAACAUCACCUUCUC<br>ACACAAUGGGGGCCUGAUAGCACCGAGCCGAGUUAGCAA<br>AUUAAUUGGGAGGGGAUUGGGAAUCCAAUCAGACGCAC<br>CAAUAGACAAUAAUUGUGAGUCCAAAUGUUUUUGGAGA<br>GGGGGUUCUAUAAAUACAAGGCUUCCCUUUCAAAAUUU<br>GUCACCAAGAACAGUGGGUCAGUGUCCUAAAUAUGUGA<br>ACAGAAGAAGCUUGAUGCUUGCAACAGGAAUGAGAAAC<br>GUACCAGAACUAAUACAAGGGAGAGGUCUAUUUGGUGC<br>AAUAGCAGGGUUUUUAGAGAAUGGGUGGGAAGGAAUGG<br>UAGAUGGCUGGUAUGGUUUCAGACAUCAAAAUGCUCAG<br>GGCACAGGCCAGGCCGCUGAUUACAAGAGUACUCAGGCA<br>GCUAUUGAUCAAAUCACUGGGAAACUGAAUAGACUUGU<br>UGAAAAAACCAAUACUGAGUUCGAGUCAAUAGAAUCUG<br>AGUUCAGUGAGAUCGAACACCAAAUCGGUAACGUCAUC<br>AAUUGGACUAAGGAUUCAAUAACCGACAUUUGGACUUA<br>UCAGGCUGAGCUGUUGGUGGCAAUGGAGAACCAGCAUA<br>CAAUCGACAUGGCUGACUCAGAGAUGUUGAAUCUAUAU<br>GAAAGAGUGAGGAAACAACUAAGGCAGAAUGCAGAAGA<br>AGAUGGGAAAGGAUGUUUUGAGAUAUAUCAUGCUUGUG<br>AUGAUUCAUGCAUGGAGAGCAUAAGAAACAACACCUAU<br>GACCAUUCACAGUACAGAGAGGAAGCUCUUUUGAACAG<br>AUUGAAUAUCAACCCAGUGACACUCUCUUCUGGAUAUA<br>AAGACAUCAUUCUCUGGUUUAGCUUCGGGGCAUCAUGU<br>UUUGUUCUUCUAGCCGUUGUCAUGGGUCUUUUCUUUUU<br>CUGUCUGAAGAAUGGAAACAUGCGAUGCACAAUCUGUA<br>UUUAG | |
| MRK_LZ_NP-<br>H3N2<br>SQ-031687<br>CX-003145 | AUGGCCAGCCAGGGCACCAAGAGAAGCUACGAGCAGAUG<br>GAGACCGACGGCGAGAGACAGAACGCCACCGAGAUCAGA<br>GCCAGCGUGGGCAAGAUGAUCGACGGCAUCGGCAGAUUC<br>UACAUCCAGAUGUGCACCGAGCUCAAGCUGAGCGACUAC<br>GAGGGCAGACUGAUCCAGAACAGCCUGACCAUCGAAAGA<br>AUGGUUCUGAGCGCCUUCGACGAGAGAAGAAACAGAUA<br>CCUGGAGGAGCACCCCAGCGCCGGCAAGGACCCCAAGAA<br>GACCGGCGGCCCCAUCUACAAGAGAGUGGACGGCAGAUG<br>GAUGAGAGAGCUGGUGCUGUACGACAAGGAGGAGAUCA<br>GAAGAAUCUGGAGACAGGCCAACAACGGCGACGACGCCA<br>CCGCCGGCCUGACCCACAUGAUGAUCUGGCACAGCAACC<br>UGAACGACACCACCUACCAGAGAACCAGAGCCCUGGUGA<br>GAACCGGCAUGGACCCCAGAAUGUGCAGCUUAAUGCAGG<br>GCAGCACCCUGCCCAGAAGAUCCGGCGCCGCUGGUGCCG<br>CCGUCAAGGGCAUCGGCACCAUGGUGAUGGAGCUGAUCC<br>GCAUGAUCAAGCGCGGCAUCAACGACAGAAACUUCUGGA<br>GAGGCGAAAACGGCAGAAAGACCAGAAGCGCCUACGAG<br>AGAAUGUGCAACAUCCUGAAGGGCAAGUUCCAGACCGCC<br>GCCCAAAGAGCCAUGAUGGACCAGGUGAGAGAGAGCAG<br>AAACCCCGGCAACGCCGAGAUCGAAGACCUGAUCUUCAG<br>CGCCAGAUCGGCCCUGAUCCUGAGAGGCAGCGUGGCCCA<br>CAAGAGCUGCCUGCCCGCCUGCGUGUAUGGCCCCGCCGU<br>GAGCAGCGGCUACAACUUCGAGAAGGAGGGCUACAGCCU<br>GGUGGGCAUCGACCCCUUCAAGCUGCUGCAGAACUCUCA<br>GGUGUAUAGCCUGAUCAGACCCAACGAGAACCCCGCCCA<br>CAAGAGCCAGCUGGUGUGGAUGGCCUGCCACAGCGCCGC<br>CUUCGAGGACCUGAGACUGCUGAGCUUCAUCAGAGGUAC<br>CAAGGUGUCCCCCAGAGGCAAGCUGAGCACCAGAGGUGU<br>GCAGAUCGCCAGCAAUGAGAACAUGGACAAUAUGGAGA<br>GCAGCACCCUGGAGCUAAGAAGCAGGUACUGGGCCAUCC<br>GGACCAGAAGCGGCGGCAAUACCAACCAGCAGAGAGCCA<br>GCGCCGGCCAGAUCAGCGUGCAGCCCACCUUCAGCGUGC<br>AGAGAAACCUGCCCUUUGAGAAGAGCACCGUGAUGGCCG<br>CCUUCACCGGCAACACCGAGGGCAGAACCAGCGACAUGA<br>GAGCCGAGAUCAUCAGAAUGAUGGAGGGCGCCAAGCCCG<br>AGGAGGUGAGCUUUAGAGGCAGAGGCGUGUUCGAGCUG<br>AGCGACGAGAAGGCCACCAACCCAAUUGUGCCCAGCUUC<br>GACAUGUCGAACGAGGGCAGCUACUUCUUCGGCGACAAC<br>GCCGAGGAGUACGACAAC | 501 |

TABLE 25-continued

Influenza mRNA Constructs
Influenza mRNA Sequences

| Construct Description | ORF | SEQ ID NO: |
|---|---|---|
| MRK_LZ_NIHG en6HASS-TM2 SQ-034074 CX-000553 | AUGGAGACCCCCGCCCAGCUGCUGUUCCUGCUGCUGCUG UGGCUGCCCGACACCACCGGCGACACCAUCUGCAUCGGC UACCACGCCAACAACAGCACCGACACCGUGGACACCGUG CUGGAGAAGAACGUGACCGUGACCCACAGCGUGAACCUG GGCAGCGGCCUGAGGAUGGUGACCGGCCUGAGGAACAUC CCCCAGAGGGAGACCAGGGGCCUGUUCGGCGCCAUCGCC GGCUUCAUCGAGGGCGGCUGGACCGGCAUGGUGGACGGC UGGUACGGCUACCACCACCAGAACGAGCAGGGCAGCGGC UACGCCGCCGACCAGAAGAGCACCCAGAACGCCAUCAAC GGCAUCACCAACAUGGUGAACAGCGUGAUCGAGAAGAU GGGCAGCGGCGGCAGCGGCACCGACCUGGCCGAGCUGCU GGUGCUGCUGCUGAACGAGAGGACCCUGGACUUCCACGA CAGCAACGUGAAGAACCUGUACGAGAAGGUGAAGAGCC AGCUGAAGAACAACGCCAAGGAGAUCGGCAACGGCUGCU UCGAGUUCUACCACAAGUGCAACAACGAGUGCAUGGAG AGCGUGAAGAACGGCACCUACGACUACCCCAAGUACAGC GAGGAGAGCAAGCUGAACAGGGAGAAGAUCGACGGAGU GAAAUUGGAAUCAAUGGGGGUCUAUCAGAUCCUGGCCA UCUACAGCACCGUGGCCAGCAGCCUGGUGCUGCUGGUGA GCCUGGGCGCCAUCAGCUUCUGGAUGUGCAGCAACGGCA GCCUGCAGUGCAGAAUCUGCAUC | 502 |
| MRK_LZ_NIHG en6HASS-foldon SQ-032106 CX-000596 | AUGGAGACCCCCGCCCAGCUGCUGUUCCUGCUGCUGCUG UGGCUGCCCGACACCACCGGCGACACCAUCUGCAUCGGC UACCACGCCAACAACAGCACCGACACCGUGGACACCGUG CUGGAGAAGAACGUGACCGUGACCCACAGCGUGAACCUG GGCAGCGGCCUGAGGAUGGUGACCGGCCUGAGGAACAUC CCCCAGAGGGAGACCAGGGGCCUGUUCGGCGCCAUCGCC GGCUUCAUCGAGGGCGGCUGGACCGGCAUGGUGGACGGC UGGUACGGCUACCACCACCAGAACGAGCAGGGCAGCGGC UACGCCGCCGACCAGAAGAGCACCCAGAACGCCAUCAAC GGCAUCACCAACAUGGUGAACAGCGUGAUCGAGAAGAU GGGCAGCGGCGGCAGCGGCACCGACCUGGCCGAGCUGCU GGUGCUGCUGCUGAACGAGAGGACCCUGGACUUCCACGA CAGCAACGUGAAGAACCUGUACGAGAAGGUGAAGAGCC AGCUGAAGAACAACGCCAAGGAGAUCGGCAACGGCUGCU UCGAGUUCUACCACAAGUGCAACAACGAGUGCAUGGAG AGCGUGAAGAACGGCACCUACGACUACCCCAAGUACAGC GAGGAGAGCAAGCUGAACAGGGAGAAGAUCGACCCCGG CAGCGGCUACAUCCCCGAGGCCCCCAGGGACGGCCAGGC CUACGUGAGGAAGGACGGCGAGUGGGUGCUGCUGAGCA CCUUCCUG | 503 |

It should be understood that each of the ORF sequences provided herein may be combined with a 5' and/or 3' UTR, such as those described herein.

TABLE 26

Additional Influenza mRNA Vaccine Constructs

| Name of antigen | | Open Reading Frame (ORF) Sequences | SEQ ID NO |
|---|---|---|---|
| MRK_pH1_ Con_RBD | DNA | ATGAAGGTGAAGCTGCTGGTGCTGCTGTGCACCTTCACCGCC ACCTACGCCGGCGTGGCCCCTCTGCACCTGGGCAAGTGCAAC ATCGCCGGCTGGATCCTGGGCAACCCTGAGTGCGAGAGCCTT AGCACAGCCTCCTCCTGGAGCTACATCGTGGAGACGAGCAGC AGCGATAACGGGACCTGCTACCCTGGCGACTTCATCGACTAC GAGGAGCTGAGAGAGCAGCTGAGCAGCGTGAGCAGCTTCGA GAGATTCGAGATCTTCCCTAAGACCAGCAGCTGGCCTAACCA CGACAGCAACAAGGGCGTGACCGCCGCCTGCCCACACGCCG GGGCCAAGAGCTTCTACAAGAACCTGATCTGGCTGGTGAAGA AGGGCAACAGCTACCCTAAACTGAGCAAGTCCTACATCAACG ACAAAGGCAAGGAGGTCCTCGTGCTCTGGGGCATCCACCACC CTAGCACCAGCGCCGATCAGCAGAGCCTGTACCAGAACGCCG ACGCGTACGTGTTCGTGGGCACCAGCAGATACAGCAAGAAGT TCAAGCCTGAGATCGCCATCAGACCTAAGGTGAGGGACCAGG AGGGCAGAATGAACTACTACTGGACCCTGGTGGAGCCCGGA | 505 |

TABLE 26-continued

Additional Influenza mRNA Vaccine Constructs

| Name of antigen | | Open Reading Frame (ORF) Sequences | SEQ ID NO |
|---|---|---|---|
| | mRNA | GATAAGATCACATTTGAGGCCACCGGCAACCTGGTGGTGCCT AGATACGCCTTCGCCATGGAGAGAAACGCC AUGAAGGUGAAGCUGCUGGUGCUGCUGUGCACCUUCACCGC CACCUACGCCGGCGUGGCCCCUCUGCACCUGGGCAAGUGCA ACAUCGCCGGCUGGAUCCUGGGCAACCCUGAGUGCGAGAGC CUUAGCACAGCCUCCUCCUGGAGCUACAUCGUGGAGACGAG CAGCAGCGAUAACGGGACCUGCUACCCUGGCGACUUCAUCG ACUACGAGGAGCUGAGAGAGCAGCUGAGCAGCGUGAGCAG CUUCGAGAGAUUCGAGAUCUUCCCUAAGACCAGCAGCUGGC CUAACCACGACAGCAACAAGGGCGUGACCGCCGCCUGCCCA CACGCCGGGGCCAAGAGCUUCUACAAGAACCUGAUCUGGCU GGUGAAGAAGGGCAACAGCUACCCUAAACUGAGCAAGUCCU ACAUCAACGACAAAGGCAAGGAGGUCCUCGUGCUCUGGGGC AUCCACCACCCUAGCACCAGCGCCGAUCAGCAGAGCCUGUA CCAGAACGCCGACGCGUACGUGUUCGUGGGCACCAGCAGAU ACAGCAAGAAGUUCAAGCCUGAGAUCGCCAUCAGACCUAAG GUGAGGGACCAGGAGGGCAGAAUGAACUACUACUGGACCC UGGUGGAGCCCGGAGAUAAGAUCACAUUUGAGGCCACCGGC AACCUGGUGGUGCCUAGAUACGCCUUCGCCAUGGAGAGAAA CGCC | 524 |
| | Protein | MKVKLLVLLCTFTATYAGVAPLHLGKCNIAGWILGNPECESLST ASSWSYIVETSSSDNGTCYPGDFIDYEELREQLSSVSSFERFEIFPK TSSWPNHDSNKGVTAACPHAGAKSFYKNLIWLVKKGNSYPKLS KSYINDKGKEVLVLWGIHHPSTSADQQSLYQNADAYVFVGTSR YSKKFKPEIAIRPKVRDQEGRMNYYWTLVEPGDKITFEATGNLV VPRYAFAMERNA | 543 |
| MRK_pH1_Con_ecto | DNA | ATGAAGGCCATCCTCGTGGTGCTGCTGTACACCTTTGCCACCG CCAACGCCGATACCCTGTGTATCGGCTACCACGCCAACAACA GCACCGACACCGTGGATACTGTCCTGGAGAAGAACGTGACCG TGACCCACAGCGTGAACCTGCTGGAGGACAAGCACAACGGC AAGCTGTGCAAGCTGAGAGGCGTGGCCCCTCTGCACCTGGGC AAGTGCAACATCGCCGGCTGGATCCTGGGCAACCCTGAGTGC GAGAGCCTTAGCACAGCCTCCTCCTGGAGCTACATCGTGGAG ACGAGCAGCAGCGATAACGGGACCTGCTACCCTGGCGACTTC ATCGACTACGAGGAGCTGAGAGAGCAGCTGAGCAGCGTGAG CAGCTTCGAGAGATTCGAGATCTTCCCTAAGACCAGCAGCTG GCCTAACCACGACAGCAACAAGGGCGTGACCGCCGCCTGCCC ACACGCCGGGGCCAAGAGCTTCTACAAGAACCTGATCTGGCT GGTGAAGAAGGGCAACAGCTACCCTAAACTGAGCAAGTCCT ACATCAACGACAAAGGCAAGGAGGTCCTCGTGCTCTGGGGCA TCCACCACCCTAGCACCAGCGCCGATCAGCAGAGCCTGTACC AGAACGCCGACGCGTACGTGTTCGTGGGCACCAGCAGATACA GCAAGAAGTTCAAGCCTGAGATCGCCATCAGACCTAAGGTGA GGGACCAGGAGGGCAGAATGAACTACTACTGGACCCTGGTG GAGCCCGGAGATAAGATCACATTTGAGGCCACCGGCAACCTG GTGGTGCCTAGATACGCCTTCGCCATGGAGAGAAACGCCGGC AGCGGCATCATCATCAGCGACACCCCTGTGCACGACTGCAAC ACCACCTGCCAGACCCCTAAGGGCGCCATCAACACGAGCCTG CCTTTCCAGAACATCCACCCTATCACCATCGGCAAGTGCCCTA AGTACGTGAAGTCAACCAAACTGAGACTCGCCACCGGCCTCA GAAACGTGCCTAGCATCCAGAGCAGAGGCCTCTTCGGCGCCA TCGCGGGATTCATCGAGGGCGGCTGGACCGGCATGGTGGACG GCTGGTACGGCTACCACCATCAGAACGAGCAGGGCAGCGGG TACGCGGCCGACCTCAAGAGCACCCAGAACGCCATCGACAA GATCACCAACAAGGTGAACAGCGTGATCGAGAAGATGAACA CCCAGTTCACCGCCGTGGGCAAGGAGTTCAACCACCTGGAGA AGAGAATCGAGAACCTGAACAAGAAGGTGGACGACGGCTTC CTGGACATCTGGACCTACAACGCAGAACTGCTCGTGCTTCTG GAGAACGAGAGAACCCTGGACTACCACGACTCCAACGTGAA GAACCTGTACGAGAAGGTGAGAAGCCAGCTGAAGAACAACG CCAAGGAGATCGGCAACGGCTGCTTCGAGTTCTACCACAAGT GCGACAACACCTGCATGGAGAGCGTGAAGAACGGCACCTAC GACTACCCTAAGTACAGCGAGGAGGCCAAGCTGAACAGAGA GGAGATCGACGGCGTGAAGCTGGAGAGCACCAGAATCGGCT CAGCCGGGAGCGCCGGCTACATCCCTGAGGCCCCTAGAGACG GCCAGGCCTACGTGAGAAAGGACGGCGAGTGGGTGCTGCTG AGCACCTTCCTG | 506 |
| | mRNA | AUGAAGGCCAUCCUCGUGGUGCUGCUGUACACCUUUGCCAC CGCCAACGCCGAUACCCUGUGUAUCGGCUACCACGCCAACA ACAGCACCGACACCGUGGAUACUGUCCUGGAGAAGAACGUG ACCGUGACCCACAGCGUGAACCUGCUGGAGGACAAGCACAA CGGCAAGCUGUGCAAGCUGAGAGGCGUGGCCCCUCUGCACC UGGGCAAGUGCAACAUCGCCGGCUGGAUCCUGGGCAACCCU GAGUGCGAGAGCCUUAGCACAGCCUCCUCCUGGAGCUACAU | 525 |

TABLE 26-continued

Additional Influenza mRNA Vaccine Constructs

| Name of antigen | | Open Reading Frame (ORF) Sequences | SEQ ID NO |
|---|---|---|---|
| | | CGUGGAGACGAGCAGCAGCGAUAACGGGACCUGCUACCCUG<br>GCGACUUCAUCGACUACGAGGAGCUGAGAGAGCAGCUGAGC<br>AGCGUGAGCAGCUUCGAGAGAUUCGAGAUCUUCCCUAAGAC<br>CAGCAGCUGGCCUAACCACGACAGCAACAAGGGCGUGACCG<br>CCGCCUGCCCACACGCCGGGGCCAAGAGCUUCUACAAGAAC<br>CUGAUCUGGCUGGUGAAGAAGGGCAACAGCUACCCUAAACU<br>GAGCAAGUCCUACAUCAACGACAAAGGCAAGGAGGUCCUCG<br>UGCUCUGGGGCAUCCACCACCCUAGCACCAGCGCCGAUCAG<br>CAGAGCCUGUACCAGAACGCCGACGCGUACGUGUUCGUGGG<br>CACCAGCAGAUACAGCAAGAAGUUCAAGCCUGAGAUCGCCA<br>UCAGACCUAAGGUGAGGGACCAGGAGGGCAGAAUGAACUA<br>CUACUGGACCCUGGUGGAGCCCGGAGAUAAGAUCACAUUUG<br>AGGCCACCGGCAACCUGGUGGUGCCUAGAUACGCCUUCGCC<br>AUGGAGAGAAACGCCGGCAGCGGCAUCAUCAUCAGCGACAC<br>CCCCUGUGCACGACUGCAACACCACCUGCCAGACCCCUAAGG<br>GCGCCAUCAACACGAGCCUGCCUUUCCAGAACAUCCACCCU<br>AUCACCAUCGGCAAGUGCCCUAAGUACGUGAAGUCAACCAA<br>ACUGAGACUCGCCACCGGCCUCAGAAACGUGCCUAGCAUCC<br>AGAGCAGAGGCCUCUUCGGCGCCAUCGCGGGAUUCAUCGAG<br>GGCGGCUGGACCGGCAUGGUGGACGGCUGGUACGGCUACCA<br>CCAUCAGAACGAGCAGGGCAGCGGGUACGCGGCCGACCUCA<br>AGAGCACCCAGAACGCCAUCGACAAGAUCACCAACAAGGUG<br>AACAGCGUGAUCGAGAAGAUGAACACCCAGUUCACCGCCGU<br>GGGCAAGGAGUUCAACCACCUGGAGAAGAGAAUCGAGAAC<br>CUGAACAAGAAGGUGGACGACGGCUUCCUGGACAUCUGGAC<br>CUACAACGCAGAACUGCUCGUGCUUCUGGAGAACGAGAGAA<br>CCCUGGACUACCACGACUCCAACGUGAAGAACCUGUACGAG<br>AAGGUGAGAAGCCAGCUGAAGAACAACGCCAAGGAGAUCG<br>GCAACGGCUGCUUCGAGUUCUACCACAAGUGCGACAACACC<br>UGCAUGGAGAGCGUGAAGAACGGCACCUACGACUACCCUAA<br>GUACAGCGAGGAGGCCAAGCUGAACAGAGAGGAGAUCGAC<br>GGCGUGAAGCUGGAGAGCACCAGAAUCGGCUCAGCCGGGAG<br>CGCCGGCUACAUCCCUGAGGCCCCUAGAGACGGCCAGGCCU<br>ACGUGAGAAAGGACGGCGAGUGGGUGCUGCUGAGCACCUU<br>CCUG | |
| | Protein | MKAILVVLLYTFATANADTLCIGYHANNSTDTVDTVLEKNVTV<br>THSVNLLEDKHNGKLCKLRGVAPLHLGKCNIAGWILGNPECESL<br>STASSWSYIVETSSSDNGTCYPGDFIDYEELREQLSSVSSFERFEIF<br>PKTSSWPNHDSNKGVTAACPHAGAKSFYKNLIWLVKKGNSYPK<br>LSKSYINDKGKEVLVLWGIHHPSTSADQQSLYQNADAYVFVGT<br>SRYSKKFKPEIAIRPKVRDQEGRMNYYWTLVEPGDKITFEATGN<br>LVVPRYAFAMERNAGSGIIISDTPVHDCNTTCQTPKGAINTSLPF<br>QNIHPITIGKCPKYVKSTKLRLATGLRNVPSIQSRGLFGAIAGFIE<br>GGWTGMVDGWYGYHHQNEQGSGYAADLKSTQNAIDKITNKV<br>NSVIEKMNTQFTAVGKEFNHLEKRIENLNKKVDDGFLDIWTYN<br>AELLVLLENERTLDYHDSNVKNLYEKVRSQLKNNAKEIGNGCF<br>EFYHKCDNTCMESVKNGTYDYPKYSEEAKLNREEIDGVKLEST<br>RIGSAGSAGYIPEAPRDGQAYVRKDGEWVLLSTFL | 544 |
| MRK_sH1_<br>Con_RBD | DNA | ATGAAGGTGAAGCTGCTGGTGCTGCTGTGCACCTTCACCGCC<br>ACCTACGCCGGAATCGCTCCCCTGCAGCTCGGCAACTGCAGC<br>GTGGCCGGCTGGATTCTGGGCAACCCCGAGTGCGAACTGCTG<br>ATTAGCAAAGAGTCCTGGAGCTACATCGTGGAAACCCCGAAT<br>CCCGAGAACGGCACCTGCTACCCCGGCTACTTCGCCGACTAC<br>GAGGAGCTAAGAGAGCAGCTGAGTAGCGTGAGCTCATTCGA<br>GAGATTCGAGATCTTTCCCAAGGAGTCTAGCTGGCCCAATCA<br>CACCGTCACCGGCGTGTCCGCCAGCTGTAGCCACAACGGCAA<br>GAGCAGCTTCTACAGAAACCTGCTGTGGCTGACCGGCAAGAA<br>CGGACTGTACCCTAACCTGAGCAAGAGCTACGCGAACAATAA<br>GGAGAAGGAGGTGCTAGTGCTGTGGGGCGTGCACCATCCGCC<br>CAACATCGGCGACCAGAGAGCCCTGTACCACACCGAGAACG<br>CCTACGTGAGCGTGGTGAGCAGCCACTATAGCAGAAGATTCA<br>CCCCTGAGATCGCCAAGAGGCCAAAGGTGAGAGATCAGGAA<br>GGAAGAATAAACTACTACTGGACCCTCCTGGAGCCCGGCGAC<br>ACCATCATCTTCGAGGCTAACGGCAACCTGATCGCCCCTAGA<br>TACGCCTTCGCCCTGAGCGAGAGGC | 507 |
| | mRNA | AUGAAGGUGAAGCUGCUGGUGCUGCUGUGCACCUUCACCGC<br>CACCUACGCCGGAAUCGCUCCCCUGCAGCUCGGCAACUGCA<br>GCGUGGCCGGCUGGAUUCUGGGCAACCCCGAGUGCGAACUG<br>CUGAUUAGCAAAGAGUCCUGGAGCUACAUCGUGGAAACCCC<br>GAAUCCCGAGAACGGCACCUGCUACCCCGGCUACUUCGCCG<br>ACUACGAGGAGCUAAGAGAGCAGCUGAGUAGCGUGAGCUC<br>AUUCGAGAGAUUCGAGAUCUUUCCCAAGGAGUCUAGCUGG<br>CCCAAUCACACCGUCACCGGCGUGUCCGCCAGCUGUAGCCA<br>CAACGGCAAGAGCAGCUUCUACAGAAACCUGCUGUGGCUGA | 526 |

TABLE 26-continued

Additional Influenza mRNA Vaccine Constructs

| Name of antigen | | Open Reading Frame (ORF) Sequences | SEQ ID NO |
|---|---|---|---|
| | | CCGGCAAGAACGGACUGUACCCUAACCUGAGCAAGAGCUAC GCGAACAAUAAGGAGAAGGAGGUGCUAGUGCUGUGGGGCG UGCACCAUCCGCCCAACAUCGGCGACCAGAGAGCCCUGUAC CACACCGAGAACGCCUACGUGAGCGUGGUGAGCAGCCACUA UAGCAGAAGAUUCACCCCUGAGAUCGCCAAGAGGCCAAAGG UGAGAGAUCAGGAAGGAAGAAUAAACUACUACUGGACCCU CCUGGAGCCCGGCGACACCAUCAUCUUCGAGGCUAACGGCA ACCUGAUCGCCCCUAGAUACGCCUUCGCCCUGAGCAGAGGC | |
| | Protein | MKVKLLVLLCTFTATYAGIAPLQLGNCSVAGWILGNPECELLIS KESWSYIVETPNPENGTCYPGYFADYEELREQLSSVSSFERFEIFP KESSWPNHTVTGVSASCSHNGKSSFYRNLLWLTGKNGLYPNLS KSYANNKEKEVLVLWGVHHPPNIGDQRALYHTENAYVSVVSSH YSRRFTPEIAKRPKVRDQEGRINYYWTLLEPGDTIIFEANGNLIAP RYAFALSRG | 545 |
| MRK_sH1_ Con_ecto | DNA | ATGAAGGTGAAGCTGCTGGTGCTGCTGTGTACCTTCACTGCC ACTTACGCCGACACCATTTGCATCGGCTACCACGCCAACAAC AGCACCGATACCGTGGACACCGTGCTGGAGAAGAACGTCACC GTGACCCACAGCGTGAACCTGCTGGAGGATAGCCATAACGGC AAGCTGTGCCTGCTGAAGGGAATCGCTCCCCTGCAGCTCGGC AACTGCAGCGTGGCCGGCTGGATTCTGGGCAACCCCGAGTGC GAACTGCTGATTAGCAAAGAGTCCTGGAGCTACATCGTGGAA ACCCCGAATCCCGAGAACGGCACCTGCTACCCCGGCTACTTC GCCGACTACGAGGAGCTAAGAGAGCAGCTGAGTAGCGTGAG CTCATTCGAGAGATTCGAGATCTTTCCCAAGGAGTCTAGCTG GCCCAATCACACCGTCACCGGCGTGTCCGCCAGCTGTAGCCA CAACGGCAAGAGCAGCTTCTACAGAAACCTGCTGTGGCTGAC CGGCAAGAACGGACTGTACCCTAACCTGAGCAAGAGCTACGC GAACAATAAGGAGAAGGAGGTGCTAGTGCTGTGGGGCGTGC ACCATCCGCCCAACATCGGCGACCAGAGAGCCCTGTACCACA CCGAGAACGCCTACGTGAGCGTGGTGAGCAGCCACTATAGCA GAAGATTCACCCCTGAGATCGCCAAGAGGCCAAAGGTGAGA GATCAGGAAGGAAGAATAAACTACTACTGGACCCTCCTGGAG CCCGGCGACACCATCATCTTCGAGGCTAACGGCAACCTGATC GCCCCTAGATACGCCTTCGCCCTGAGCAGAGGCTTCGGCAGC GGCATCATCACCAGCAACGCTCCCATGGACGAGTGCGACGCC AAGTGCCAGACCCCGCAGGGCGCCATCAACTCGAGCCTGCCC TTCCAGAACGTGCACCCCGTGACCATCGGCGAGTGCCCCAAG TACGTGAGAAGCGCCAAGCTGAGAATGGTGACCGGCCTGAG AAACATCCCAAGCATCCAGAGCAGAGGGCTGTTCGGCGCCAT CGCTGGCTTCATCGAGGGCGGCTGGACCGGCATGGTGGACGG CTGGTACGGTTATCACCACCAGAACGAGCAGGGCAGCGGCTA CGCCGCCGACCAGAAGTCCACCCAGAACGCCATCAACGGCAT TACAAACAAGGTGAACAGCGTTATCGAGAAGATGAACACCC AATTCACCGCCGTGGGCAAGGAGTTCAACAAGCTGGAGAGA AGAATGGAGAACCTGAACAAGAAGGTGGACGACGGCTTCCT GGACATCTGGACCTACAACGCCGAACTGCTGGTCCTGCTGGA GAACGAGAGAACCCTGGACTTCCACGACTCCAACGTGAAGA ACTTATACGAGAAGGTCAAATCCCAGCTGAAGAACAACGCCA AAGAAATCGGAAACGGCTGCTTCGAATTCTACCACAAGTGCA ACGACGAGTGCATGGAGAGCGTGAAGAACGGAACCTACGAC TACCCCAAGTACAGCGAGGAAAGCAAACTGAACAGAGAGAA GATCGACGGCGTGAAGTTAGAGAGCATGGGCGTGGGCAGCG CCGGCTCTGCTGGATACATCCCTGAGGCCCCTAGAGACGGCC AGGCCTACGTGAGAAAGGACGGCGAGTGGGTGCTGCTGAGC ACCTTCCTG | 508 |
| | mRNA | AUGAAGGUGAAGCUGCUGGUGCUGCUGUGUACCUUCACUG CCACUUACGCCGACACCAUUUGCAUCGGCUACCACGCCAAC AACAGCACCGAUACCGUGGACACCGUGCUGGAGAAGAACGU CACCGUGACCCACAGCGUGAACCUGCUGGAGGAUAGCCAUA ACGGCAAGCUGUGCCUGCUGAAGGGAAUCGCUCCCCUGCAG CUCGGCAACUGCAGCGUGGCCGGCUGGAUUCUGGGCAACCC CGAGUGCGAACUGCUGAUUAGCAAAGAGUCCUGGAGCUAC AUCGUGGAAACCCCGAAUCCCGAGAACGGCACCUGCUACCC CGGCUACUUCGCCGACUACGAGGAGCUAAGAGAGCAGCUGA GUAGCGUGAGCUCAUUCGAGAGAUUCGAGAUCUUUCCCAA GGAGUCUAGCUGGCCCAAUCACACCGUCACCGGCGUGUCCG CCAGCUGUAGCCACAACGGCAAGAGCAGCUUCUACAGAAAC CUGCUGUGGCUGACCGGCAAGAACGGACUGUACCCUAACCU GAGCAAGAGCUACGCGAACAAUAAGGAGAAGGAGGUGCUA GUGCUGUGGGGCGUGCACCAUCCGCCCAACAUCGGCGACCA GAGAGCCCUGUACCACACCGAGAACGCCUACGUGAGCGUGG UGAGCAGCCACUAUAGCAGAAGAUUCACCCCUGAGAUCGCC AAGAGGCCAAAGGUGAGAGAUCAGGAAGGAAGAAUAAACU ACUACUGGACCCUCCUGGAGCCCGGCGACACCAUCAUCUUC | 527 |

TABLE 26-continued

Additional Influenza mRNA Vaccine Constructs

| Name of antigen | | Open Reading Frame (ORF) Sequences | SEQ ID NO |
|---|---|---|---|
| | | GAGGCUAACGGCAACCUGAUCGCCCCUAGAUACGCCUUCGC CCUGAGCAGAGGCUUCGGCAGCGGCAUCAUCACCAGCAACG CUCCCAUGGACGAGUGCGACGCCAAGUGCCAGACCCCGCAG GGCGCCAUCAACUCGAGCCUGCCCUUCCAGAACGUGCACCC CGUGACCAUCGGCGAGUGCCCCAAGUACGUGAGAAGCGCCA AGCUGAGAAUGGUGACCGGCCUGAGAAACAUCCCAAGCAUC CAGAGCAGAGGGCUGUUCGGCGCCAUCGCUGGCUUCAUCGA GGGCGGCUGGACCGGCAUGGUGGACGGCUGGUACGGUUAU CACCACCAGAACGAGCAGGGCAGCGGCUACGCCGCCGACCA GAAGUCCACCCAGAACGCCAUCAACGGCAUUACAAACAAGG UGAACAGCGUUAUCGAGAAGAUGAACACCCAAUUCACCGCC GUGGGCAAGGAGUUCAACAAGCUGGAGAGAAGAAUGGAGA ACCUGAACAAGAAGGUGGACGACGGCUUCCUGGACAUCUGG ACCUACAACGCCGAACUGCUGGUCCUGCUGGAGAACGAGAG AACCCUGGACUUCCACGACUCCAACGUGAAGAACUUAUACG AGAAGGUCAAAUCCCAGCUGAAGAACAACGCCAAAGAAAUC GGAAACGGCUGCUUCGAAUUCUACCACAAGUGCAACGACGA GUGCAUGGAGAGCGUGAAGAACGGAACCUACGACUACCCCA AGUACAGCGAGGAAAGCAAACUGAACAGAGAGAAGAUCGA CGGCGUGAAGUUAGAGAGCAUGGGCGUGGGCAGCGCCGGC UCUGCUGGAUACAUCCCUGAGGCCCCUAGAGACGGCCAGGC CUACGUGAGAAAGGACGGCGAGUGGGUGCUGCUGAGCACC UUCCUG | |
| | Protein | MKVKLLVLLCTFTATYADTICIGYHANNSTDTVDTVLEKNVTVT HSVNLLEDSHNGKLCLLKGIAPLQLGNCSVAGWILGNPECELLIS KESWSYIVETPNPENGTCYPGYFADYEELREQLSSVSSFERFEIFP KESSWPNHTVTGVSASCSHNGKSSFYRNLLWLTGKNGLYPNLS KSYANNKEKEVLVLWGVHHPPNIGDQRALYHTENAYVSVVSSH YSRRFTPEIAKRPKVRDQEGRINYYWTLLEPGDTIIFEANGNLIAP RYAFALSRGFGSGIITSNAPMDECDAKCQTPQGAINSSLPFQNVH PVTIGECPKYVRSAKLRMVTGLRNIPSIQSRGLFGAIAGFIEGGW TGMVDGWYGYHHQNEQGSGYAADQKSTQNAINGITNKVNSVI EKMNTQFTAVGKEFNKLERRMENLNKKVDDGFLDIWTYNAEL LVLLENERTLDFHDSNVKNLYEKVKSQLKNNAKEIGNGCFEFY HKCNDECMESVKNGTYDYPKYSEESKLNREKIDGVKLESMGVG SAGSAGYIPEAPRDGQAYVRKDGEWVLLSTFL | 546 |
| MRK_sH1_Con_v2 | DNA | ATGAAGGTGAAACTCCTCGTCCTGCTGTGCACCTTCACCGCC ACCTACGCCGATACCATCTGTATTGGCTACCACGCCAACAAC TCCACCGACACCGTGGATACCGTGCTCGAGAAGAACGTGACC GTGACCCACAGCGTGAACCTGCTGGAGAACAGCCACAACGG CAAGCTGTGCCTGCTGAAGGGCATCGCGCCCCTGCAGTTGGG TAACTGCTCCGTGGCCGGCTGGATCCTGGGCAACCCTGAGTG CGAGCTGCTGATCAGCAAGGAGAGCTGGAGCTACATCGTGGA GAAGCCTAACCCCGAGAACGGCACCTGCTACCCTGGCCACTT CGCCGACTACGAGGAGCTGAGAGAGCAACTCAGCAGCGTGA GCAGCTTCGAGAGATTCGAGATCTTCCCTAAGGAGAGCAGCT GGCCCAATCACACTGTGACCGGCGTGTCCGCTTCTTGCAGCC ATAACGGGGAAAGCTCCTTCTACAGAAATCTCCTTTGGCTGA CGGGGAAGAACGGCCTGTACCCTAACCTGAGCAAGAGCTAC GCCAACAACAAGGAGAAGGAGGTGCTGGTGCTGTGGGGCGT GCACCACCCTCCTAACATCGGCGACCAGAAGGCCCTGTACCA CACCGAGAACGCCTACGTCAGCGTGGTGTCCAGCCACTACAG CAGAAAGTTCACCCCTGAGATCGCCAAGAGGCCTAAGGTGCG GGACCAGGAGGGCAGAATCAACTACTACTGGACCCTGCTGGA GCCTGGCGACACCATCATCTTCGAGGCCAACGGCAACCTGAT CGCCCCTAGATACGCCTTCGCCCTGAGCAGAGGCTTCGGCAG CGGCATCATCAACAGCAACGCCCCTATGGACAAGTGCGACGC CAAGTGCCAGACTCCGCAGGGCGCTATCAACAGCTCCCTGCC TTTCCAGAACGTGCACCCTGTGACCATCGGCGAGTGCCCTAA GTACGTGAGAAGCGCCAAGCTGAGAATGGTGACCGGCCTGA GAAACATCCCTAGCATCCAGAGCAGAGGCCTGTTCGGCGCCA TCGCCGGGTTTATCGAGGGCGGCTGGACCGGCATGGTGGACG GCTGGTACGGCTACCACCACCAGAACGAGCAGGGCTCCGGCT ACGCCGCCGACCAGAAATCCACCCAGAACGCCATCAACGGC ATCACCAACAAGGTGAACAGCGTCATCGAGAAGATGAACAC CCAGTTCACCGCCGTGGGCAAGGAGTTCAACAAGCTGGAGAG AAGAATGGAGAACCTGAACAAGAAGGTGGACGACGGCTTCA TCGACATCTGGACCTACAACGCCGAGCTTCTGGTGCTCCTGG AGAACGAGAGAACCCTGGACTTCCACGACAGCAACGTGAAG AACCTGTACGAGAAGGTGAAGTCCCAGCTGAAGAACAACGC CAAGGAGATCGGCAACGGCTGCTTCGAGTTCTACCACAAGTG CAACGACGAGTGCATGGAGAGCGTGAAGAACGGCACCTACG ATTACCCCAAGTACAGCGAGGAGAGCAAGCTGAACAGAGAG AAGATCGACGGCGTGAAGCTGGAGAGCATGGGCGTGTACCA | 509 |

TABLE 26-continued

Additional Influenza mRNA Vaccine Constructs

| Name of antigen | | Open Reading Frame (ORF) Sequences | SEQ ID NO |
|---|---|---|---|
| | | GATCCTGGCCATCTACTCCACCGTGGCCAGTAGCCTGGTGCT GCTGGTGAGCCTGGGCGCAATCAGCTTCTGGATGTGCAGCAA CGGCAGCCTGCAGTGCAGAATCTGCATC | |
| | mRNA | AUGAAGGUGAAACUCCUCGUCCUGCUGUGCACCUUCACCGC CACCUACGCCGAUACCAUCUGUAUUGGCUACCACGCCAACA ACUCCACCGACACCGUGGAUACCGUGCUCGAGAAGAACGUG ACCGUGACCCACAGCGUGAACCUGCUGGAGAACAGCCACAA CGGCAAGCUGUGCCUGCUGAAGGGCAUCGCGCCCCUGCAGU UGGGUAACUGCUCCGUGGCCGGCUGGAUCCUGGGCAACCCU GAGUGCGAGCUGCUGAUCAGCAAGGAGAGCUGGAGCUACA UCGUGGAGAAGCCUAACCCCGAGAACGGCACCUGCUACCCU GGCCACUUCGCCGACUACGAGGAGCUGAGAGAGCAACUCAG CAGCGUGAGCAGCUUCGAGAGAUUCGAGAUCUUCCCUAAGG AGAGCAGCUGGCCCAAUCACACUGUGACCGGCGUGUCCGCU UCUUGCAGCCAUAACGGGGAAAGCUCCUUCUACAGAAAUCU CCUUUGGCUGACGGGGAAGAACGGCCUGUACCCUAACCUGA GCAAGAGCUACGCCAACAACAAGGAGAAGGAGGUGCUGGU GCUGUGGGGCGUGCACCACCCUCCUAACAUCGGCGACCAGA AGGCCCUGUACCACACCGAGAACGCCUACGUCAGCGUGGUG UCCAGCCACUACAGCAGAAAGUUCACCCCUGAGAUCGCCAA GAGGCCUAAGGUGCGGGACCAGGAGGGCAGAAUCAACUAC UACUGGACCCUGCUGGAGCCUGGCGACACCAUCAUCUUCGA GGCCAACGGCAACCUGAUCGCCCCUAGAUACGCCUUCGCCC UGAGCAGAGGCUUCGGCAGCGGCAUCAUCAACAGCAACGCC CCUAUGGACAAGUGCGACGCCAAGUGCCAGACUCCGCAGGG CGCUAUCAACAGCUCCCUGCCUUUCCAGAACGUGCACCCUG UGACCAUCGGCGAGUGCCCUAAGUACGUGAGAAGCGCCAAG CUGAGAAUGGUGACCGGCCUGAGAAACAUCCCUAGCAUCCA GAGCAGAGGCCUGUUCGGCGCCAUCGCCGGGUUUAUCGAGG GCGGCUGGACCGGCAUGGUGGACGGCUGGUACGGCUACCAC CACCAGAACGAGCAGGGCUCCGGCUACGCCGCCGACCAGAA AUCCACCCAGAACGCCAUCAACGGCAUCACCAACAAGGUGA ACAGCGUCAUCGAGAAGAUGAACACCCAGUUCACCGCCGUG GGCAAGGAGUUCAACAAGCUGGAGAGAAGAAUGGAGAACC UGAACAAGAAGGUGGACGACGGCUUCAUCGACAUCUGGACC UACAACGCCGAGCUUCUGGUGCUCCUGGAGAACGAGAGAAC CCUGGACUUCCACGACAGCAACGUGAAGAACCUGUACGAGA AGGUGAAGUCCCAGCUGAAGAACAACGCCAAGGAGAUCGGC AACGGCUGCUUCGAGUUCUACCACAAGUGCAACGACGAGUG CAUGGAGAGCGUGAAGAACGGCACCUACGAUUACCCCAAGU ACAGCGAGGAGAGCAAGCUGAACAGAGAGAAGAUCGACGG CGUGAAGCUGGAGAGCAUGGGCGUGUACCAGAUCCUGGCCA UCUACUCCACCGUGGCCAGUAGCCUGGUGCUCUGGUGAGC CUGGGCGCAAUCAGCUUCUGGAUGUGCAGCAACGGCAGCCU GCAGUGCAGAAUCUGCAUC | 528 |
| | Protein | MKVKLLVLLCTFTATYADTICIGYHANNSTDTVDTVLEKNVTVT HSVNLLENSHNGKLCLLKGIAPLQLGNCSVAGWILGNPECELLIS KESWSYIVEKPNPENGTCYPGHFADYEELREQLSSVSSFERFEIFP KESSWPNHTVTGVSASCSHNGESSFYRNLLWLTGKNGLYPNLS KSYANNKEKEVLVLWGVHHPPNIGDQKALYHTENAYVSVVSS HYSRKFTPEIAKRPKVRDQEGRINYYWTLLEPGDTIIFEANGNLI APRYAFALSRGFGSGIINSNAPMDKCDAKCQTPQGAINSSLPFQN VHPVTIGECPKYVRSAKLRMVTGLRNIPSIQSRGLFGAIAGFIEGG WTGMVDGWYGYHHQNEQGSGYAADQKSTQNAINGITNKVNS VIEKMNTQFTAVGKEFNKLERRMENLNKKVDDGFIDIWTYNAE LLVLLENERTLDFHDSNVKNLYEKVKSQLKNNAKEIGNGCFEFY HKCNDECMESVKNGTYDYPKYSEESKLNREKIDGVKLESMGVY QILAIYSTVASSLVLLVSLGAISFWMCSNGSLQCRICI | 547 |
| MRK_RBS-HA129 | DNA | ATGAAGGTCAAACTTCTCGTGCTCCTGTGCACCTTCACCGCCA CCTACGCGGGCGTGGCTCCGCTTCACCTGGGCAAGTGCAACA TCGCCGGTTGGCTGCTGGGTAACCCAGAGTGCGAGCTACTGC TGACCGTGAGCAGCTGGAGCTACATCGTGGAAACCAGCAACA GCGACAACGGCACCTGCTACCCTGGCGACTTCATCAACTACG AGGAGCTGAGAGAGCAGCTCAGCAGCGTGTCCAGCTTCGAG AGATTCGAGATCTTCCCTAAGACTAGCAGCTGGCCCGACCAC GAAACAAACAGAGGCGTGACCGCCGCTTGTCCATACGCCGGC GCCAACAGCTTCTACAGAAACCTGATCTGGCTGGTGAAGAAG GGCAACAGCTACCCTAAGCTGAGCAAGAGCTACGTGAACAA CAAGGGCAAGGAGGTGCTTGTGCTGTGGGGCATCCACCACCC TCCTACCAGCACCGACCAGCAGAGCCTGTACCAGAACGCCGA CGCCTACGTGTTCGTGGGCAGCAGCAGATACAGCAAGAAGTT CAAGCCTGAGATCGCCATCAGACCTAAGGTGAGGGACCAGG AGGGCAGAATGAACTACTACTGGACTCTGGTGGAGCCCGGCG | 510 |

TABLE 26-continued

Additional Influenza mRNA Vaccine Constructs

| Name of antigen | | Open Reading Frame (ORF) Sequences | SEQ ID NO |
|---|---|---|---|
| | mRNA | ACAAGATCACCTTCGAGGCCACCGGCAACCTGGTGGTGCCTA GATACGCCTTCGCCATGGAGAGAAACGCC AUGAAGGUCAAACUUCUCGUGCUCCUGUGCACCUUCACCGC CACCUACGCGGGCGUGGCUCCGCUUCACCUGGGCAAGUGCA ACAUCGCCGGUUGGCUGCUGGGUAACCCAGAGUGCGAGCUA CUGCUGACCGUGAGCAGCUGGAGCUACAUCGUGGAAACCAG CAACAGCGACAACGGCACCUGCUACCCUGGCGACUUCAUCA ACUACGAGGAGCUGAGAGAGCAGCUCAGCAGCGUGUCCAGC UUCGAGAGAUUCGAGAUCUUCCCUAAGACUAGCAGCUGGCC CGACCACGAAACAAACAGAGGCGUGACCGCCGCUUGUCCAU ACGCCGGCGCCAACAGCUUCUACAGAAACCUGAUCUGGCUG GUGAAGAAGGGCAACAGCUACCCUAAGCUGAGCAAGAGCU ACGUGAACAACAAGGGCAAGGAGGUGCUUGUGCUGUGGGG CAUCCACCACCCUCCUACCAGCACCGACCAGCAGAGCCUGU ACCAGAACGCCGACGCCUACGUGUUCGUGGGCAGCAGCAGA UACAGCAAGAAGUUCAAGCCUGAGAUCGCCAUCAGACCUAA GGUGAGGGACCAGGAGGGCAGAAUGAACUACUACUGGACU CUGGUGGAGCCCGGCGACAAGAUCACCUUCGAGGCCACCGG CAACCUGGUGGUGCCUAGAUACGCCUUCGCCAUGGAGAGAA ACGCC | 529 |
| | Protein | MKVKLLVLLCTFTATYAGVAPLHLGKCNIAGWLLGNPECELLL TVSSWSYIVETSNSDNGTCYPGDFINYEELREQLSSVSSFERFEIF PKTSSWPDHETNRGVTAACPYAGANSFYRNLIWLVKKGNSYPK LSKSYVNNKGKEVLVLWGIHHPPTSTDQQSLYQNADAYVFVGS SRYSKKFKPEIAIRPKVRDQEGRMNYYWTLVEPGDKITFEATGN LVVPRYAFAMERNA | 548 |
| MRK_H1_ cot_all | DNA | ATGAAGGCCATCCTGGTCGTGCTGCTCTACACATTCGCCACC GCCAACGCAGACACTCTGTGCATCGGCTACCACGCCAACAAC AGCACCGACACCGTGGATACCGTGCTGGAGAAGAACGTGAC CGTGACCCACAGCGTGAACCTGCTGGAGGACAAGCACAACG GCAAGCTGTGCAAGCTGAGAGGCGTGGCCCCTCTGCACCTGG GCAAGTGCAACATCGCCGGCTGGATCCTGGGAAACCCCGAGT GCGAGAGCCTGTCAACCGCCTCGAGCTGGTCCTACATCGTGG AAACCAGCAGCAGCGATAACGGGACGTGCTACCCGGGCGAC TTCATCAACTACGAGGAGCTGAGAGAACAGCTGAGCAGCGTC AGTAGCTTCGAGAGATTCGAGATCTTCCCTAAGACCAGCAGC TGGCCTAACCACGACAGCAACAAGGGCGTGACCGCCGCTTGC CCGCACGCAGGCGCCAAGAGCTTCTACAAGAACCTGATCTGG CTGGTGAAGAAGGGCAACAGCTACCCTAAGCTGAGCAAGAG CTACATCAACGACAAGGGGAAGGAGGTGCTAGTCCTGTGGG GCATCCATCACCCTAGCACCACAGCCGACCAGCAAAGCCTGT ACCAGAACGCGGACGCCTACGTGTTCGTCGGCACCAGCAGAT ACAGCAAGAAGTTCAAGCCTGAGATCGCCATCAGACCTAAGG TGCGAGATCAGGAGGGCAGAATGAACTACTACTGGACCCTGG TGGAGCCCGGAGACAAGATTACTTTCGAAGCGACCGGCAACC TGGTGGTGCCTAGATACGCCTTCGCCATGGAGAGAAACGCCG GCAGCGGCATCATCATCAGCGACACCCCTGTGCACGACTGCA ACACCACCTGCCAGACCCCTAAAGGCGCCATCAACACAAGCC TGCCTTTTCAGAACATCCACCCTATCACCATCGGCAAGTGCCC TAAGTACGTGAAGTCCACCAAGCTCCGCCTGGCAACCGGCCT CAGGAACGTGCCTAGCATCCAGAGCAGAGGCCTGTTCGGGGC CATAGCCGGCTTCATAGAGGGTGGCTGGACCGGCATGGTTGA CGGGTGGTACGGATACCATCACCAGAACGAGCAAGGCAGCG GCTACGCCGCAGACCTGAAGTCAACCCAGAACGCCATCGACA AGATCACCAACAAGGTGAACAGCGTGATCGAGAAGATGAAC ACCCAGTTCACCGCCGTGGGCAAGGAGTTCAACCACCTAGAG AAGAGGATCGAGAACCTGAATAAGAAGGTGGACGACGGCTT CCTGGACATCTGGACCTACAACGCCGAGCTGCTCGTCCTCCT GGAGAACGAGAGAACCCTGGACTACCACGATAGCAACGTGA AGAACCTGTACGAGAAGGTGAGAAACCAGCTGAAGAATAAC GCCAAGGAGATCGGCAACGGCTGCTTCGAGTTCTACCACAAG TGCGACAACACCTGCATGGAGAGCGTGAAGAACGGCACCTA CGACTACCCTAAGTACAGCGAGGAGGCCAAGCTGAACAGAG AGAAGATCGACGGCGTGAAGCTGGAGAGCACCAGAATCTAC CAGATCCTGGCCATCTACAGCACCGTGGCCAGCAGCCTCGTG CTCGTGGTGAGCCTGGGCGCCATCTCCTTCTGGATGTGCAGC AACGGCAGCCTGCAGTCAGAATCTGCATC | 511 |
| | mRNA | AUGAAGGCCAUCCUGGUCGUGCUGCUCUACACAUUCGCCAC CGCCAACGCAGACACUCUGUGCAUCGGCUACCACGCCAACA ACAGCACCGACACCGUGGAUACCGUGCUGGAGAAGAACGUG ACCGUGACCCACAGCGUGAACCUGCUGGAGGACAAGCACAA CGGCAAGCUGUGCAAGCUGAGAGGCGUGGCCCCUCUGCACC UGGGCAAGUGCAACAUCGCCGGCUGGAUCCUGGGAAACCCC GAGUGCGAGAGCCUGUCAACCGCCUCGAGCUGGUCCUACAU | 530 |

TABLE 26-continued

Additional Influenza mRNA Vaccine Constructs

| Name of antigen | | Open Reading Frame (ORF) Sequences | SEQ ID NO |
|---|---|---|---|
| | | CGUGGAAACCAGCAGCAGCGAUAACGGGACGUGCUACCCGG<br>GCGACUUCAUCAACUACGAGGAGCUGAGAGAACAGCUGAGC<br>AGCGUCAGUAGCUUCGAGAGAUUCGAGAUCUUCCCUAAGAC<br>CAGCAGCUGGCCUAACCACGACAGCAACAAGGGCGUGACCG<br>CCGCUUGCCCGCACGCAGGCGCCAAGAGCUUCUACAAGAAC<br>CUGAUCUGGCUGGUGAAGAAGGGCAACAGCUACCCUAAGCU<br>GAGCAAGAGCUACAUCAACGACAAGGGGAAGGAGGUGCUA<br>GUCCUGUGGGGCAUCCAUCACCCUAGCACCACAGCCGACCA<br>GCAAAGCCUGUACCAGAACGCGGACGCCUACGUGUUCGUCG<br>GCACCAGCAGAUACAGCAAGAAGUUCAAGCCUGAGAUCGCC<br>AUCAGACCUAAGGUGCGAGAUCAGGAGGGCAGAAUGAACU<br>ACUACUGGACCCUGGUGGAGCCCGGAGACAAGAUUACUUUC<br>GAAGCGACCGGCAACCUGGUGGUGCCUAGAUACGCCUUCGC<br>CAUGGAGAGAAACGCCGGCAGCGGCAUCAUCAUCAGCGACA<br>CCCCUGUGCACGACUGCAACACCACCUGCCAGACCCCUAAA<br>GGCGCCAUCAACACAAGCCUGCCUUUUCAGAACAUCCACCC<br>UAUCACCAUCGGCAAGUGCCCUAAGUACGUGAAGUCCACCA<br>AGCUCCGCCUGGCAACCGGCCUCAGGAACGUGCCUAGCAUC<br>CAGAGCAGAGGCCUGUUCGGGGCCAUAGCCGGCUUCAUAGA<br>GGGUGGCUGGACCGGCAUGGUUGACGGGUGGUACGGAUAC<br>CAUCACCAGAACGAGCAAGGCAGCGGCUACGCCGCAGACCU<br>GAAGUCAACCCAGAACGCCAUCGACAAGAUCACCAACAAGG<br>UGAACAGCGUGAUCGAGAAGAUGAACACCCAGUUCACCGCC<br>GUGGGCAAGGAGUUCAACCACCUAGAGAAGAGGAUCGAGA<br>ACCUGAAUAAGAAGGUGGACGACGGCUUCCUGGACAUCUG<br>GACCUACAACGCCGAGCUGCUCGUCCUCCUGGAGAACGAGA<br>GAACCCUGGACUACCACGAUAGCAACGUGAAGAACCUGUAC<br>GAGAAGGUGAGAAACCAGCUGAAGAAUAACGCCAAGGAGA<br>UCGGCAACGGCUGCUUCGAGUUCUACCACAAGUGCGACAAC<br>ACCUGCAUGGAGAGCGUGAAGAACGGCACCUACGACUACCC<br>UAAGUACAGCGAGGAGGCCAAGCUGAACAGAGAGAAGAUC<br>GACGGCGUGAAGCUGGAGAGCACCAGAAUCUACCAGAUCCU<br>GGCCAUCUACAGCACCGUGGCCAGCAGCCUCGUGCUCGUGG<br>UGAGCCUGGGCGCCAUCUCCUUCUGGAUGUGCAGCAACGGC<br>AGCCUGCAGUGCAGAAUCUGCAUC | |
| | Protein | MKAILVVLLYTFATANADTLCIGYHANNSTDTVDTVLEKNVTV<br>THSVNLLEDKHNGKLCKLRGVAPLHLGKCNIAGWILGNPECESL<br>STASSWSYIVETSSSDNGTCYPGDFINYEELREQLSSVSSFERFEIF<br>PKTSSWPNHDSNKGVTAACPHAGAKSFYKNLIWLVKKGNSYPK<br>LSKSYINDKGKEVLVLWGIHHPSTTADQQSLYQNADAYVFVGT<br>SRYSKKFKPEIAIRPKVRDQEGRMNYYWTLVEPGDKITFEATGN<br>LVVPRYAFAMERNAGSGIIISDTPVHDCNTTCQTPKGAINTSLPF<br>QNIHPITIGKCPKYVKSTKLRLATGLRNVPSIQSRGLFGAIAGFIE<br>GGWTGMVDGWYGYHHQNEQGSGYAADLKSTQNAIDKITNKV<br>NSVIEKMNTQFTAVGKEFNHLEKRIENLNKKVDDGFLDIWTYN<br>AELLVLLENERTLDYHDSNVKNLYEKVRNQLKNNAKEIGNGCF<br>EFYHKCDNTCMESVKNGTYDYPKYSEEAKLNREKIDGVKLEST<br>RIYQILAIYSTVASSLVLVVSLGAISFWMCSNGSLQCRICI | 549 |
| MRK_H3_ConA | DNA | ATGAAGACCATCATCGCCCTGAGCTACATCCTGTGCCTGGTG<br>TTCGCGCAGAAACTCCCCGGCAACGACAATAGCACTGCCACC<br>CTGTGTCTGGGCCATCACGCCGTGCCTAACGGAACCCTCGTG<br>AAGACGATCACCAACGACCAGATCGAGGTGACCAACGCCAC<br>CGAGCTGGTCCAGAGTTCGAGCACCGGCAGAATCTGCGACAG<br>CCCTCACCGGATCCTGGACGGCGAGAACTGCACCCTGATTGA<br>CGCACTGCTAGGCGACCCACACTGTGACGGCTTCCAGAACAA<br>GGAGTGGGACCTGTTCGTGGAGAGAAGCAAGGCCTACAGCA<br>ACTGCTACCCTTACGACGTGCCTGACTACGCCAGCCTGAGAT<br>CCCTCGTGGCCTCCAGCGGCACCCTCGAGTTCAATAACGAGA<br>GCTTCAACTGGACCGGAGTCGCCCAGAACGGGACATCCTACG<br>CCTGCAAGAGAGGAAGCGTCAAGAGCTTCTTCAGCAGACTGA<br>ACTGGCTGCACCAGCTGAAGTACAAGTACCCTGCCCTGAACG<br>TGACCATGCCTAACAACGACAAGTTCGACAAGCTGTACATCT<br>GGGGCGTGCACCATCCCAGCACCGACAGCGACCAGACCTCCC<br>TGTACGTCCAGGCATCCGGCAGGGTCACCGTGAGCACCAAGA<br>GAAGCCAGCAGACCGTGATCCCTAACATCGGCAGCAGACCTT<br>GGGTCAGAGGCGTCTCTAGCAGAATCAGCATCTACTGGACCA<br>TAGTGAAGCCCGGCGACATCCTGCTGATCAACTCGACCGGCA<br>ACCTGATCGCTCCTAGGGGCTACTTCAAGATCAGAAGCGGCA<br>AGAGCAGCATCATGAGAAGCGACGCGCCCATCGGGAAGTGC<br>AACTCCGAGTGCATCACCCCTAACGGCAGCATCCCCAACGAC<br>AAGCCTTTCCAGAACGTGAACGAATCACCTACGGCGCCTGC<br>CCTAGATACGTGAAGCAGAACACACTGAAGCTGGCCACCGGC<br>ATGAGGAACGTGCCTGAGAAGCAGACCAGAGGCATCTTCGG<br>GGCTATTGCCGGCTTCATCGAGAACGGTTGGGAGGGAATGGT | 512 |

TABLE 26-continued

Additional Influenza mRNA Vaccine Constructs

| Name of antigen | | Open Reading Frame (ORF) Sequences | SEQ ID NO |
|---|---|---|---|
| | | CGACGGGTGGTACGGCTTCAGACACCAGAACAGCGAAGGCA<br>CGGGACAGGCCGCCGACCTCAAGTCCACCCAGGCTGCCATCA<br>ATCAGATCAACGGGAAGCTGAACAGACTGATCGAGAAGACC<br>AACGAGAAGTTCCACCAGATCGAGAAGGAGTTCAGCGAGGT<br>GGAGGGCAGAATCCAGGACCTGGAGAAGTACGTGGAGGACA<br>CGAAGATCGACCTGTGGAGCTACAACGCAGAGCTGTTGGTGG<br>CACTGGAGAACCAGCACACCATCGACCTGACCGACAGCGAG<br>ATGAACAAGCTGTTCGAGAGGACCAGGAAGCAGTTACGAGA<br>GAACGCCGAGGACATGGGAAACGGCTGTTTTAAGATCTACCA<br>CAAGTGCGACAACGCCTGCATCGGGAGCATCAGGAACGGGA<br>CCTACGACCACGACGTGTACAGAGACGAGGCCCTGAACAAC<br>AGATTCCAGATCAAGGGCGTGGAGCTGAAGTCCGGCTACAAG<br>GACTGGATCCTGTGGATCAGCTTCGCCATCAGCTGCTTCCTGC<br>TGTGCGTGGTCCTCCTGGGCTTTATAATGTGGGCCTGCCAGAA<br>GGGCAACATCAGGTGCAACATCTGCATC | |
| | mRNA | AUGAAGACCAUCAUCGCCCUGAGCUACAUCCUGUGCCUGGU<br>GUUCGCGCAGAAACUCCCCGGCAACGACAAUAGCACUGCCA<br>CCCUGUGUCUGGGCCAUCACGCCGUGCCUAACGGAACCCUC<br>GUGAAGACGAUCACCAACGACCAGAUCGAGGUGACCAACGC<br>CACCGAGCUGGUCCAGAGUUCGAGCACCGGCAGAAUCUGCG<br>ACAGCCCUCACCGGAUCCUGGACGGCGAGAACUGCACCCUG<br>AUUGACGCACUGCUAGGCGACCCACACUGUGACGGCUUCCA<br>GAACAAGGAGUGGGACCUGUUCGUGGAGAGAAGCAAGGCC<br>UACAGCAACUGCUACCCUUACGACGUGCCUGACUACGCCAG<br>CCUGAGAUCCCUCGUGGCCUCCAGCGGCACCCUCGAGUUCA<br>AUAACGAGAGCUUCAACUGGACCGGAGUCGCCCAGAACGGG<br>ACAUCCUACGCCUGCAAGAGAGGAAGCGUCAAGAGCUUCUU<br>CAGCAGACUGAACUGGCUGCACCAGCUGAAGUACAAGUACC<br>UGCCCUGAACGUGACCAUGCCUAACAACGACAAGUUCGAC<br>AAGCUGUACAUCUGGGGCGUGCACCAUCCCAGCACCGACAG<br>CGACCAGACCUCCCUGUACGUCCAGGCAUCCGGCAGGGUCA<br>CCGUGAGCACCAAGAGAAGCCAGCAGACCGUGAUCCCUAAC<br>AUCGGCAGCAGACCUUGGGUCAGAGGCGUCUCUAGCAGAAU<br>CAGCAUCUACUGGACCAUAGUGAAGCCCGGCGACAUCCUGC<br>UGAUCAACUCGACCGGCAACCUGAUCGCUCCUAGGGGCUAC<br>UUCAAGAUCAGAAGCGGCAAGAGCAGCAUCAUGAGAAGCG<br>ACGCGCCCAUCGGGAAGUGCAACUCCGAGUGCAUCACCCCU<br>AACGGCAGCAUCCCCAACGACAAGCCUUUCCAGAACGUGAA<br>CAGAAUCACCUACGGCGCCUGCCCUAGAUACGUGAAGCAGA<br>ACACACUGAAGCUGGCCACCGGCAUGAGGAACGUGCCUGAG<br>AAGCAGACCAGAGGCAUCUUCGGGGCUAUUGCCGGCUUCAU<br>CGAGAACGGUUGGGAGGGAAUGGUCGACGGGUGGUACGGC<br>UUCAGACACCAGAACAGCGAAGGCACGGGACAGGCCGCCGA<br>CCUCAAGUCCACCCAGGCUGCCAUCAAUCAGAUCAACGGGA<br>AGCUGAACAGACUGAUCGAGAAGACCAACGAGAAGUUCCAC<br>CAGAUCGAGAAGGAGUUCAGCGAGGUGGAGGGCAGAAUCC<br>AGGACCUGGAGAAGUACGUGGAGGACACGAAGAUCGACCU<br>GUGGAGCUACAACGCAGAGCUGUUGGUGGCACUGGAGAAC<br>CAGCACACCAUCGACCUGACCGACAGCGAGAUGAACAAGCU<br>GUUCGAGAGGACCAGGAAGCAGUUACGAGAGAACGCCGAG<br>GACAUGGGAAACGGCUGUUUUAAGAUCUACCACAAGUGCG<br>ACAACGCCUGCAUCGGGAGCAUCAGGAACGGGACCUACGAC<br>CACGACGUGUACAGAGACGAGGCCCUGAACAACAGAUUCCA<br>GAUCAAGGGCGUGGAGCUGAAGUCCGGCUACAAGGACUGG<br>AUCCUGUGGAUCAGCUUCGCCAUCAGCUGCUUCCUGCUGUG<br>CGUGGUCCUCCUGGGCUUUAUAAUGUGGGCCUGCCAGAAGG<br>GCAACAUCAGGUGCAACAUCUGCAUC | 531 |
| | Protein | MKTIIALSYILCLVFAQKLPGNDNSTATLCLGHHAVPNGTLVKTI<br>TNDQIEVTNATELVQSSSTGRICDSPHRILDGENCTLIDALLGDPH<br>CDGFQNKEWDLFVERSKAYSNCYPYDVPDYASLRSVASSGTL<br>EFNNESFNWTGVAQNGTSYACKRGSVKSFFSRLNWLHQLKYKY<br>PALNVTMPNNDKFDKLYIWGVHHPSTDSDQTSLYVQASGRVTV<br>STKRSQQTVIPNIGSRPWVRGVSSRISIYWTIVKPGDILLINSTGNL<br>IAPRGYFKIRSGKSSIMRSDAPIGKCNSECITPNGSIPNDKPFQNV<br>NRITYGACPRYVKQNTLKLATGMRNVPEKQTRGIFGAIAGFIEN<br>GWEGMVDGWYGFRHQNSEGTGQAADLKSTQAAINQINGKLNR<br>LIEKTNEKFHQIEKEFSEVEGRIQDLEKYVEDTKIDLWSYNAELL<br>VALENQHTIDLTDSEMNKLFERTRKQLRENAEDMGNGCFKIYH<br>KCDNACIGSIRNGTYDHDVYRDEALNNRFQIKGVELKSGYKDW<br>ILWISFAISCFLLCVVLLGFIMWACQKGNIRCNICI | 550 |
| MRK_H3_ConB | DNA | ATGAAGACCATCATCGCCCTGAGCTACATCCTGTGCCTGGTG<br>TTCGCGCAGAAACTCCCCGGCAACGACAATAGCACTGCCACC<br>CTGTGTCTGGGCCATCACGCCGTGCCTAACGGAACCATCGTG<br>AAGACGATCACCAACGACCAGATCGAGGTGACCAACGCCAC | 513 |

TABLE 26-continued

Additional Influenza mRNA Vaccine Constructs

| Name of antigen | Open Reading Frame (ORF) Sequences | SEQ ID NO |
|---|---|---|
| | CGAGCTGGTCCAGAATTCGAGCACCGGCGAAATCTGCGACAG | |
| | CCCTCACCAGATCCTGGACGGCGAGAACTGCACCCTGATTGA | |
| | CGCACTGCTAGGCGACCCACAGTGTGACGGCTTCCAGAACAA | |
| | GAAGTGGGACCTGTTCGTGGAGAGAAGCAAGGCCTACAGCA | |
| | ACTGCTACCCTTACGACGTGCCTGACTACGCCAGCCTGAGAT | |
| | CCCTCGTGGCCTCCAGCGGCACCCTCGAGTTCAATAACGAGA | |
| | GCTTCAACTGGACCGGAGTCACCCAGAACGGGACATCCAGCG | |
| | CCTGCATCAGAAGAAGCAACAGCAGCTTCTTCAGCAGACTGA | |
| | ACTGGCTGACCCACCTGAACTTCAAGTACCCTGCCCTGAACG | |
| | TGACCATGCCTAACAACGAGCAGTTCGACAAGCTGTACATCT | |
| | GGGGCGTGCACCATCCCGGCACCGACAAGGACCAGATCTTCC | |
| | TGTACGCCCAGAGCTCCGGCAGGATCACCGTGAGCACCAAGA | |
| | GAAGCCAGCAGGCCGTGATCCCTAACATCGGCAGCAGACCTA | |
| | GAATCAGAAACATCCCTAGCAGAATCAGCATCTACTGGACCA | |
| | TAGTGAAGCCCGGCGACATCCTGCTGATCAACTCGACCGGCA | |
| | ACCTGATCGCTCCTAGGGGCTACTTCAAGATCAGAAGCGGCA | |
| | AGAGCAGCATCATGAGAAGCGACGCGCCCATCGGGAAGTGC | |
| | AACTCCGAGTGCATCACCCCTAACGGCAGCATCCCCAACGAC | |
| | AAGCCTTTCCAGAACGTGAACAGAATCACCTACGGCGCCTGC | |
| | CCTAGATACGTGAAGCAGAGCACACTGAAGCTGGCCACCGGC | |
| | ATGAGGAACGTGCCTGAGAAGCAGACCAGAGGCATCTTCGG | |
| | GGCTATTGCCGGCTTCATCGAGAACGGTTGGGAGGGAATGGT | |
| | CGACGGGTGGTACGGCTTCAGACACCAGAACAGCGAAGGCA | |
| | GGGGACAGGCCGCCGACCTCAAGTCCACCCAGGCTGCCATCG | |
| | ATCAGATCAACGGGAAGCTGAACAGACTGATCGGCAAGACC | |
| | AACGAGAAGTTCCACCAGATCGAGAAGGAGTTCAGCGAGGT | |
| | GGAGGGCAGAATCCAGGACCTGGAGAAGTACGTGGAGGACA | |
| | CGAAGATCGACCTGTGGAGCTACAACGCAGAGCTGTTGGTGG | |
| | CACTGGAGAACCAGCACACCATCGACCTGACCGACAGCGAG | |
| | ATGAACAAGCTGTTCGAGAAGACCAAGAAGCAGTTACGAGA | |
| | GAACGCCGAGGACATGGGAAACGGCTGTTTTAAGATCTACCA | |
| | CAAGTGCGACAACGCCTGCATCGGGAGCATCAGGAACGGGA | |
| | CCTACGACCACGACGTGTACAGAGACGAGGCCCTGAACAAC | |
| | AGATTCCAGATCAAGGGCGTGGAGCTGAAGTCCGGCTACAAG | |
| | GACTGGATCCTGTGGATCAGCTTCGCCATCAGCTGCTTCCTGC | |
| | TGTGCGTGGCCCTCCTGGGCTTTATAATGTGGGCCTGCCAGA | |
| | AGGGCAACATCAGGTGCAACATCTGCATC | |
| mRNA | AUGAAGACCAUCAUCGCCCUGAGCUACAUCCUGUGCCUGGU | 532 |
| | GUUCGCGCAGAAACUCCCCGGCAACGACAAUAGCACUGCCA | |
| | CCCUGUGUCUGGGCCAUCACGCCGUGCCUAACGGAACCAUC | |
| | GUGAAGACGAUCACCAACGACCAGAUCGAGGUGACCAACGC | |
| | CACCGAGCUGGUCCAGAAUUCGAGCACCGGCGAAAUCUGCG | |
| | ACAGCCCUCACCAGAUCCUGGACGGCGAGAACUGCACCCUG | |
| | AUUGACGCACUGCUAGGCGACCCACAGUGUGACGGCUUCCA | |
| | GAACAAGAAGUGGGACCUGUUCGUGGAGAGAAGCAAGGCC | |
| | UACAGCAACUGCUACCCUUACGACGUGCCUGACUACGCCAG | |
| | CCUGAGAUCCCUCGUGGCCUCCAGCGGCACCCUCGAGUUCA | |
| | AUAACGAGAGCUUCAACUGGACCGGAGUCACCCAGAACGGG | |
| | ACAUCCAGCGCCUGCAUCAGAAGAAGCAACAGCAGCUUCUU | |
| | CAGCAGACUGAACUGGCUGACCCACCUGAACUUCAAGUACC | |
| | CUGCCCUGAACGUGACCAUGCCUAACAACGAGCAGUUCGAC | |
| | AAGCUGUACAUCUGGGGCGUGCACCAUCCCGGCACCGACAA | |
| | GGACCAGAUCUUCCUGUACGCCCAGAGCUCCGGCAGGAUCA | |
| | CCGUGAGCACCAAGAGAAGCCAGCAGGCCGUGAUCCCUAAC | |
| | AUCGGCAGCAGACCUAGAAUCAGAAACAUCCCUAGCAGAAU | |
| | CAGCAUCUACUGGACCAUAGUGAAGCCCGGCGACAUCCUGC | |
| | UGAUCAACUCGACCGGCAACCUGAUCGCUCCUAGGGGCUAC | |
| | UUCAAGAUCAGAAGCGGCAAGAGCAGCAUCAUGAGAAGCG | |
| | ACGCGCCCAUCGGGAAGUGCAACUCCGAGUGCAUCACCCCU | |
| | AACGGCAGCAUCCCCAACGACAAGCCUUUCCAGAACGUGAA | |
| | CAGAAUCACCUACGGCGCCUGCCCUAGAUACGUGAAGCAGA | |
| | GCACACUGAAGCUGGCCACCGGCAUGAGGAACGUGCCUGAG | |
| | AAGCAGACCAGAGGCAUCUUCGGGGCUAUUGCCGGCUUCAU | |
| | CGAGAACGGUUGGGAGGGAAUGGUCGACGGGUGGUACGGC | |
| | UUCAGACACCAGAACAGCGAAGGCAGGGGACAGGCCGCCGA | |
| | CCUCAAGUCCACCCAGGCUGCCAUCGAUCAGAUCAACGGGA | |
| | AGCUGAACAGACUGAUCGGCAAGACCAACGAGAAGUUCCAC | |
| | CAGAUCGAGAAGGAGUUCAGCGAGGUGGAGGGCAGAAUCC | |
| | AGGACCUGGAGAAGUACGUGGAGGACACGAAGAUCGACCU | |
| | GUGGAGCUACAACGCAGAGCUGUUGGUGGCACUGGAGAAC | |
| | CAGCACACCAUCGACCUGACCGACAGCGAGAUGAACAAGCU | |
| | GUUCGAGAAGACCAAGAAGCAGUUACGAGAGAACGCCGAG | |
| | GACAUGGGAAACGGCUGUUUUAAGAUCUACCACAAGUGCG | |
| | ACAACGCCUGCAUCGGGAGCAUCAGGAACGGGACCUACGAC | |
| | CACGACGUGUACAGAGACGAGGCCCUGAACAACAGAUUCCA | |

TABLE 26-continued

Additional Influenza mRNA Vaccine Constructs

| Name of antigen | | Open Reading Frame (ORF) Sequences | SEQ ID NO |
|---|---|---|---|
| | Protein | GAUCAAGGGCGUGGAGCUGAAGUCCGGCUACAAGGACUGG<br>AUCCUGUGGAUCAGCUUCGCCAUCAGCUGCUUCCUGCUGUG<br>CGUGGCCCUCCUGGGCUUUAUAAUGUGGGCCUGCCAGAAGG<br>GCAACAUCAGGUGCAACAUCUGCAUC<br>MKTIIALSYILCLVFAQKLPGNDNSTATLCLGHHAVPNGTIVKTI<br>TNDQIEVTNATELVQNSSTGEICDSPHQILDGENCTLIDALLGDP<br>QCDGFQNKKWDLFVERSKAYSNCYPYDVPDYASLRSLVASSGT<br>LEFNNESFNWTGVTQNGTSSACIRRSNSSFFSRLNWLTHLNFKYP<br>ALNVTMPNNEQFDKLYIWGVHHPGTDKDQIFLYAQSSGRITVST<br>KRSQQAVIPNIGSRPRIRNIPSRISIYWTIVKPGDILLINSTGNLIAP<br>RGYFKIRSGKSSIMRSDAPIGKCNSECITPNGSIPNDKPFQNVNRI<br>TYGACPRYVKQSTLKLATGMRNVPEKQTRGIFGAIAGFIENGWE<br>GMVDGWYGFRHQNSEGRGQAADLKSTQAAIDQINGKLNRLIGK<br>TNEKFHQIEKEFSEVEGRIQDLEKYVEDTKIDLWSYNAELLVALE<br>NQHTIDLTDSEMNKLFEKTKKQLRENAEDMGNGCFKIYHKCDN<br>ACIGSIRNGTYDHDVYRDEALNNRFQIKGVELKSGYKDWILWIS<br>FAISCFLLCVALLGFIMWACQKGNIRCNICI | 551 |
| MRK_H3_<br>con_all | DNA | ATGAAGACCATCATCGCCCTGAGCTACATCCTGTGCCTGGTG<br>TTCGCGCAGAAACTCCCCGGCAACGACAATAGCACTGCCACC<br>CTGTGTCTGGGCCATCACGCCGTGCCTAACGGAACCATCGTG<br>AAGACGATCACCAACGACCAGATCGAGGTGACCAACGCCAC<br>CGAGCTGGTCCAGAGTTCGAGCACCGGCGAAATCTGCGACAG<br>CCCTCACCAGATCCTGGACGGCGAGAACTGCACCCTGATTGA<br>CGCACTGCTAGGCGACCCACAGTGTGACGGCTTCCAGAACAA<br>GAAGTGGGACCTGTTCGTGGAGAGAAGCAAGGCCTACAGCA<br>ACTGCTACCCTTACGACGTGCCTGACTACGCCAGCCTGAGAT<br>CCCTCGTGGCCTCCAGCGGCACCCTCGAGTTCAATAACGAGA<br>GCTTCAACTGGACCGGAGTCACCCAGAACGGGACATCCAGCG<br>CCTGCATCAGAAGAAGCAACAGCAGCTTCTTCAGCAGACTGA<br>ACTGGCTGACCCACCTGAACTTCAAGTACCCTGCCCTGAACG<br>TGACCATGCCTAACAACGAGCAGTTCGACAAGCTGTACATCT<br>GGGGCGTGCACCATCCCGGCACCGACAAGGACCAGATCTTCC<br>TGTACGCCCAGGCATCCGGCAGGATCACCGTGAGCACCAAGA<br>GAAGCCAGCAGGCCGTGATCCCTAACATCGGCAGCAGACCTA<br>GAGTCAGAAACATCCCTAGCAGAATCAGCATCTACTGGACCA<br>TAGTGAAGCCCGGCGACATCCTGCTGATCAACTCGACCGGCA<br>ACCTGATCGCTCCTAGGGGCTACTTCAAGATCAGAAGCGGCA<br>AGAGCAGCATCATGAGAAGCGACGCGCCCATCGGGAAGTGC<br>AACTCCGAGTGCATCACCCCTAACGGCAGCATCCCCAACGAC<br>AAGCCTTTCCAGAACGTGAACAGAATCACCTACGGCGCCTGC<br>CCTAGATACGTGAAGCAGAACACACTGAAGCTGGCCACCGGC<br>ATGAGGAACGTGCCTGAGAAGCAGACCAGAGGCATCTTCGG<br>GGCTATTGCCGGCTTCATCGAGAACGGTTGGGAGGGAATGGT<br>CGACGGGTGGTACGGCTTCAGACACCAGAACAGCGAAGGCA<br>GGGGACAGGCCGCCGACCTCAAGTCCACCCAGGCTGCCATCG<br>ATCAGATCAACGGGAAGCTGAACAGACTGATCGGCAAGACC<br>AACGAGAAGTTCCACCAGATCGAGAAGGAGTTCAGCGAGGT<br>GGAGGGCAGAATCCAGGACCTGGAGAAGTACGTGGAGGACA<br>CGAAGATCGACCTGTGGAGCTACAACGCAGAGCTGTTGGTGG<br>CACTGGAGAACCAGCACACCATCGACCTGACCGACAGCGAG<br>ATGAACAAGCTGTTCGAGAAGACCAAGAAGCAGTTACGAGA<br>GAACGCCGAGGACATGGGAAACGGCTGTTTTAAGATCTACCA<br>CAAGTGCGACAACGCCTGCATCGGGAGCATCAGGAACGGGA<br>CCTACGACCACGACGTGTACAGAGACGAGGCCCTGAACAAC<br>AGATTCCAGATCAAGGGCGTGGAGCTGAAGTCCGGCTACAAG<br>GACTGGATCCTGTGGATCAGCTTCGCCATCAGCTGCTTCCTGC<br>TGTGCGTGGCCCTCCTGGGCTTTATAATGTGGGCCTGCCAGA<br>AGGGCAACATCAGGTGCAACATCTGCATC | 514 |
| | mRNA | AUGAAGACCAUCAUCGCCCUGAGCUACAUCCUGUGCCUGGU<br>GUUCGCGCAGAAACUCCCCGGCAACGACAAUAGCACUGCCA<br>CCCUGUGUCUGGGCCAUCACGCCGUGCCUAACGGAACCAUC<br>GUGAAGACGAUCACCAACGACCAGAUCGAGGUGACCAACGC<br>CACCGAGCUGGUCCAGAGUUCGAGCACCGGCGAAAUCUGCG<br>ACAGCCCUCACCAGAUCCUGGACGGCGAGAACUGCACCCUG<br>AUUGACGCACUGCUAGGCGACCCACAGUGUGACGGCUUCCA<br>GAACAAGAAGUGGGACCUGUUCGUGGAGAGAAGCAAGGCC<br>UACAGCAACUGCUACCCUUACGACGUGCCUGACUACGCCAG<br>CCUGAGAUCCCUCGUGGCCUCCAGCGGCACCCUCGAGUUCA<br>AUAACGAGAGCUUCAACUGGACCGGAGUCACCCAGAACGGG<br>ACAUCCAGCGCCUGCAUCAGAAGAAGCAACAGCAGCUUCUU<br>CAGCAGACUGAACUGGCUGACCCACCUGAACUUCAAGUACC<br>CUGCCCUGAACGUGACCAUGCCUAACAACGAGCAGUUCGAC<br>AAGCUGUACAUCUGGGGCGUGCACCAUCCCGGCACCGACAA<br>GGACCAGAUCUUCCUGUACGCCCAGGCAUCCGGCAGGAUCA | 533 |

TABLE 26-continued

Additional Influenza mRNA Vaccine Constructs

| Name of antigen | | Open Reading Frame (ORF) Sequences | SEQ ID NO |
|---|---|---|---|
| | | CCGUGAGCACCAAGAGAAGCCAGCAGGCCGUGAUCCCUAAC<br>AUCGGCAGCAGACCUAGAGUCAGAAACAUCCCUAGCAGAAU<br>CAGCAUCUACUGGACCAUAGUGAAGCCCGGCGACAUCCUGC<br>UGAUCAACUCGACCGGCAACCUGAUCGCUCCUAGGGGCUAC<br>UUCAAGAUCAGAAGCGGCAAGAGCAGCAUCAUGAGAAGCG<br>ACGCGCCCAUCGGGAAGUGCAACUCCGAGUGCAUCACCCCU<br>AACGGCAGCAUCCCCAACGACAAGCCUUUCCAGAACGUGAA<br>CAGAAUCACCUACGGCGCCUGCCCUAGAUACGUGAAGCAGA<br>ACACACUGAAGCUGGCCACCGGCAUGAGGAACGUGCCUGAG<br>AAGCAGACCAGAGGCAUCUUCGGGGCUAUUGCCGGCUUCAU<br>CGAGAACGGUUGGGAGGGAAUGGUCGACGGGUGGUACGGC<br>UUCAGACACCAGAACAGCGAAGGCAGGGGACAGGCCGCCGA<br>CCUCAAGUCCACCCAGGCUGCCAUCGAUCAGAUCAACGGGA<br>AGCUGAACAGACUGAUCGGCAAGACCAACGAGAAGUUCCAC<br>CAGAUCGAGAAGGAGUUCAGCGAGGUGGAGGGCAGAAUCC<br>AGGACCUGGAGAAGUACGUGGAGGACACGAAGAUCGACCU<br>GUGGAGCUACAACGCAGAGCUGUUGGUGGCACUGGAGAAC<br>CAGCACACCAUCGACCUGACCGACAGCGAGAUGAACAAGCU<br>GUUCGAGAAGACCAAGAAGCAGUUACGAGAACGCCGAG<br>GACAUGGGAAACGGCUGUUUUAAGAUCUACCACAAGUGCG<br>ACAACGCCUGCAUCGGGAGCAUCAGGAACGGGACCUACGAC<br>CACGACGUGUACAGAGACGAGGCCCUGAACAACAGAUUCCA<br>GAUCAAGGGCGUGGAGCUGAAGUCCGGCUACAAGGACUGG<br>AUCCUGUGGAUCAGCUUCGCCAUCAGCUGCUUCCUGCUGUG<br>CGUGGCCCUCCUGGGCUUUAUAAUGUGGGCCUGCCAGAAGG<br>GCAACAUCAGGUGCAACAUCUGCAUC | |
| | Protein | MKTIIALSYILCLVFAQKLPGNDNSTATLCLGHHAVPNGTIVKTI<br>TNDQIEVTNATELVQSSSTGEICDSPHQILDGENCTLIDALLGDPQ<br>CDGFQNKKWDLFVERSKAYSNCYPYDVPDYASLRSLVASSGTL<br>EFNNESFNWTGVTQNGTSSACIRRSNSSFFSRLNWLTHLNFKYP<br>ALNVTMPNNEQFDKLYIWGVHHPGTDKDQIFLYAQASGRITVST<br>KRSQQAVIPNIGSRPRVRNIPSRISIYWTIVKPGDILLINSTGNLIAP<br>RGYFKIRSGKSSIMRSDAPIGKCNSECITPNGSIPNDKPFQNVNRI<br>TYGACPRYVKQNTLKLATGMRNVPEKQTRGIFGAIAGFIENGW<br>EGMVDGWYGFRHQNSEGRGQAADLKSTQAAIDQINGKLNRLIG<br>KTNEKFHQIEKEFSEVEGRIQDLEKYVEDTKIDLWSYNAELLVA<br>LENQHTIDLTDSEMNKLFEKTKKQLRENAEDMGNGCFKIYHKC<br>DNACIGSIRNGTYDHDVYRDEALNNRFQIKGVELKSGYKDWIL<br>WISFAISCFLLCVALLGFIMWACQKGNIRCNICI | 552 |
| MRK_H3_cot_all | DNA | ATGAAGACCATCATCGCCCTGAGCTACATCCTGTGCCTGGTG<br>TTCGCGCAGAAACTCCCCGGCAACGACAATAGCACTGCCACC<br>CTGTGTCTGGGCCATCACGCCGTGCCTAACGGAACCATCGTG<br>AAGACGATCACCAACGACAGAATCGAGGTGACCAACGCCAC<br>CGAGCTGGTCCAGAATTCGAGCATCGGCGAAATCTGCGACAG<br>CCCTCACCAGATCCTGGACGGCGAGAACTGCACCCTGATTGA<br>CGCACTGCTAGGCGACCCACAGTGTGACGGCTTCCAGAACAA<br>GAAGTGGGACCTGTTCGTGGAGAGAAGCAAGGCCTACAGCA<br>ACTGCTACCCTTACGACGTGCCTGACTACGCCAGCCTGAGAT<br>CCCTCGTGGCCTCCAGCGGCACCCTCGAGTTCAATAACGAGA<br>GCTTCAACTGGACCGGAGTCACCCAGAACGGGACATCCAGCG<br>CCTGCATCAGAAGAAGCAACAGCAGCTTCTTCAGCAGACTGA<br>ACTGGCTGACCCACCTGAACTTCAAGTACCCTGCCCTGAACG<br>TGACCATGCCTAACAACGAGCAGTTCGACAAGCTGTACATCT<br>GGGGCGTGCACCATCCCGGCACCGACAAGGACCAGATCTTCC<br>TGTACGCCCAGAGCTCCGGCAGGATCACCGTGAGCACCAAGA<br>GAAGCCAGCAGGCCGTGATCCCTAACATCGGCAGCAGACCTA<br>GAATCAGAAACATCCCTAGCAGAATCAGCATCTACTGGACCA<br>TAGTGAAGCCCGGCGACATCCTGCTGATCAACTCGACCGGCA<br>ACCTGATCGCTCCTAGGGGCTACTTCAAGATCAGAAGCGGCA<br>AGAGCAGCATCATGAGAAGCGACGCGCCCATCGGGAAGTGC<br>AAGTCCGAGTGCATCACCCCTAACGGCAGCATCCCCAACGAC<br>AAGCCTTTCCAGAACGTGAACAGAATCACCTACGGCGCCTGC<br>CCTAGATACGTGAAGCAGAGCACACTGAAGCTGGCCACCGGC<br>ATGAGGAACGTGCCTGAGAAGCAGACCAGAGGCATCTTCGG<br>GGCTATTGCCGGCTTCATCGAGAACGGTTGGGAGGGAATGGT<br>CGACGGGTGGTACGGCTTCAGACACCAGAACAGCGAAGGCA<br>GGGGACAGGCCGCCGACCTCAAGTCCACCCAGGCTGCCATCG<br>ATCAGATCAACGGGAAGCTGAACAGACTGATCGGCAAGACC<br>AACGAGAAGTTCCACCAGATCGAGAAGGAGTTCAGCGAGGT<br>GGAGGGCAGAATCCAGGACCTGGAGAAGTACGTGGAGGACA<br>CGAAGATCGACCTGTGGAGCTACAACGCAGAGCTGTTGGTGG<br>CACTGGAGAACCAGCACACCATCGACCTGACCGACAGCGAG<br>ATGAACAAGCTGTTCGAGAAGACCAAGAAGCAGTTACGAGA<br>GAACGCCGAGGACATGGGAAACGGCTGTTTTAAGATCTACCA | 515 |

TABLE 26-continued

Additional Influenza mRNA Vaccine Constructs

| Name of antigen | | Open Reading Frame (ORF) Sequences | SEQ ID NO |
|---|---|---|---|
| | | CAAGTGCGACAACGCCTGCATCGGGAGCATCAGGAACGGGA<br>CCTACGACCACGACGTGTACAGAGACGAGGCCCTGAACAAC<br>AGATTCCAGATCAAGGGCGTGGAGCTGAAGTCCGGCTACAAG<br>GACTGGATCCTGTGGATCAGCTTCGCCATCAGCTGCTTCCTGC<br>TGTGCGTGGCCCTCCTGGGCTTTATAATGTGGGCCTGCCAGA<br>AGGGCAACATCAGGTGCAACATCTGCATC | |
| | mRNA | AUGAAGACCAUCAUCGCCCUGAGCUACAUCCUGUGCCUGGU<br>GUUCGCGCAGAAACUCCCCGGCAACGACAAUAGCACUGCCA<br>CCCUGUGUCUGGGCCAUCACGCCGUGCCUAACGGAACCAUC<br>GUGAAGACGAUCACCAACGACAGAAUCGAGGUGACCAACGC<br>CACCGAGCUGGUCCAGAAUUCGAGCAUCGGCGAAAUCUGCG<br>ACAGCCCUCACCAGAUCCUGGACGGCGAGAACUGCACCCUG<br>AUUGACGCACUGCUAGGCGACCCACAGUGUGACGGCUUCCA<br>GAACAAGAAGUGGGACCUGUUCGUGGAGAAGCAAGGCC<br>UACAGCAACUGCUACCCUUACGACGUGCCUGACUACGCCAG<br>CCUGAGAUCCCUCGUGGCCUCCAGCGGCACCCUCGAGUUCA<br>AUAACGAGAGCUUCAACUGGACCGGAGUCACCCAGAACGGG<br>ACAUCCAGCGCCUGCAUCAGAAGAAGCAACAGCAGCUUCUU<br>CAGCAGACUGAACUGGCUGACCCACCUGAACUUCAAGUACC<br>CUGCCCUGAACGUGACCAUGCCUAACAACGAGCAGUUCGAC<br>AAGCUGUACAUCUGGGGCGUGCACCAUCCCGGCACCGACAA<br>GGACCAGAUCUUCCUGUACGCCCAGAGCUCCGGCAGGAUCA<br>CCGUGAGCACCAAGAGAAGCCAGCAGGCCGUGAUCCCUAAC<br>AUCGGCAGCAGACCUAGAAUCAGAAACAUCCCUAGCAGAAU<br>CAGCAUCUACUGGACCAUAGUGAAGCCCGGCGACAUCCUGC<br>UGAUCAACUCGACCGGCAACCUGAUCGCUCCUAGGGGCUAC<br>UUCAAGAUCAGAAGCGGCAAGAGCAGCAUCAUGAGAAGCG<br>ACGCGCCCAUCGGGAAGUGCAAGUCCGAGUGCAUCACCCCU<br>AACGGCAGCAUCCCCAACGACAAGCCUUUCCAGAACGUGAA<br>CAGAAUCACCUACGGCGCCUGCCCUAGAUACGUGAAGCAGA<br>GCACACUGAAGCUGGCCACCGGCAUGAGGAACGUGCCUGAG<br>AAGCAGACCAGAGGCAUCUUCGGGGCUAUUGCCGGCUUCAU<br>CGAGAACGGUUGGGAGGGAAUGGUCGACGGGUGGUACGGC<br>UUCAGACACCAGAACAGCGAAGGCAGGGGACAGGCCGCCGA<br>CCUCAAGUCCACCCAGGCUGCCAUCGAUCAGAUCAACGGGA<br>AGCUGAACAGACUGAUCGGCAAGACCAACGAGAAGUUCCAC<br>CAGAUCGAGAAGGAGUUCAGCGAGGUGGAGGGCAGAAUCC<br>AGGACCUGGAGAAGUACGUGGAGGACACGAAGAUCGACCU<br>GUGGAGCUACAACGCAGAGCUGUUGGUGGCACUGGAGAAC<br>CAGCACACCAUCGACCUGACCGACAGCGAGAUGAACAAGCU<br>GUUCGAGAAGACCAAGAAGCAGUUACGAGAGAACGCCGAG<br>GACAUGGGAAACGGCUGUUUUAAGAUCUACCACAAGUGCG<br>ACAACGCCUGCAUCGGGAGCAUCAGGAACGGGACCUACGAC<br>CACGACGUGUACAGAGACGAGGCCCUGAACAACAGAUUCCA<br>GAUCAAGGGCGUGGAGCUGAAGUCCGGCUACAAGGACUGG<br>AUCCUGUGGAUCAGCUUCGCCAUCAGCUGCUUCCUGCUGUG<br>CGUGGCCCUCCUGGGCUUUAUAAUGUGGGCCUGCCAGAAGG<br>GCAACAUCAGGUGCAACAUCUGCAUC | 534 |
| | Protein | MKTIIALSYILCLVFAQKLPGNDNSTATLCLGHHAVPNGTIVKTI<br>TNDRIEVTNATELVQNSSIGEICDSPHQILDGENCTLIDALLGDPQ<br>CDGFQNKKWDLFVERSKAYSNCYPYDVPDYASLRSLVASSGTL<br>EFNNESFNWTGVTQNGTSSACIRRSNSSFFSRLNWLTHLNFKYP<br>ALNVTMPNNEQFDKLYIWGVHHPGTDKDQIFLYAQSSGRITVST<br>KRSQQAVIPNIGSRPRIRNIPSRISIYWTIVKPGDILLINSTGNLIAP<br>RGYFKIRSGKSSIMRSDAPIGKCKSECITPNGSIPNDKPFQNVNRI<br>TYGACPRYVKQSTLKLATGMRNVPEKQTRGIFGAIAGFIENGWE<br>GMVDGWYGFRHQNSEGRGQAADLKSTQAAIDQINGKLNRLIGK<br>TNEKFHQIEKEFSEVEGRIQDLEKYVEDTKIDLWSYNAELLVALE<br>NQHTIDLTDSEMNKLFEKTKKQLRENAEDMGNGCFKIYHKCDN<br>ACIGSIRNGTYDHDVYRDEALNNRFQIKGVELKSGYKDWILWIS<br>FAISCFLLCVALLGFIMWACQKGNIRCNICI | 553 |
| RBD1-<br>Cal09-PC-<br>Cb | DNA | ATGAAGGTGAAGCTTCTCGTGCTCTTATGCACCTTCACCGCCA<br>CCTACGCCGGCGTGGCTCCGCTTCACCTTGGCAAGTGCAACA<br>TCGCCGGCTGGATCTTGGGAAACCCCGAGTGCGAGAGCTTGA<br>GCACCGCCAGCAGCTGGAGCAACATCACGGAAACCCCTAGC<br>AGCGACAACGGCACCTGCTACCCCGGCGACTTCATCGACTAC<br>GAGGAGCTGCGGGAGCAGCTGAGCAGCGTGAGCAGCTTCGA<br>GCGGTTCGAGATCTTCCCCAAGACCAGCTCTTGGCCCAACCA<br>CAGCAGCAACAAGGGCGTGACCGCCGCCTGCCCTCACGCTGG<br>CGCCAAGAGCTTCTACAAGAACCTGATCTGGCTGGTGAAGAA<br>GAACGGCAGCTACCCCAAGCTGAACAAGTCTTACATTAACGA<br>CTCAGGCAAGGAGGTGCTGGTCCTGTGGGGCATCCACCACCC<br>CAGCAACAGCACCGACCAACAGAGCCTGTACCAGAACGCCG<br>ACACCTACGTGTTCGTGGGCAGCAGCAACTACAGCAAGGAGT | 516 |

TABLE 26-continued

Additional Influenza mRNA Vaccine Constructs

| Name of antigen | | Open Reading Frame (ORF) Sequences | SEQ ID NO |
|---|---|---|---|
| | | TCAAGCCCGAGATCGCCATCCGGCCCAAGGTGCGGGACCAGG AGGGCCGGATGAACTACTACTGGACCCTGGTGGAGCCTGGCG ACAAGATCACCTTCGAGGCCACCGGCAACCTGGTGGTGCCCC GGTACGCCTTCGCCATGGAGCGGAACGCC | |
| | mRNA | AUGAAGGUGAAGCUUCUCGUGCUCUUAUGCACCUUCACCGC CACCUACGCCGGCGUGGCUCCGCUUCACCUUGGCAAGUGCA ACAUCGCCGGCUGGAUCUUGGGAAACCCCGAGUGCGAGAGC UUGAGCACCGCCAGCAGCUGGAGCAACAUCACGGAAACCCC UAGCAGCGACAACGGCACCUGCUACCCCGGCGACUUCAUCG ACUACGAGGAGCUGCGGGAGCAGCUGAGCAGCGUGAGCAGC UUCGAGCGGUUCGAGAUCUUCCCCAAGACCAGCUCUUGGCC CAACCACAGCAGCAACAAGGGCGUGACCGCCGCCUGCCCUC ACGCUGGCGCCAAGAGCUUCUACAAGAACCUGAUCUGGCUG GUGAAGAAGAACGGCAGCUACCCCAAGCUGAACAAGUCUUA CAUUAACGACUCAGGCAAGGAGGUGCUGGUCCUGUGGGGC AUCCACCACCCCAGCAACAGCACCGACCAACAGAGCCUGUA CCAGAACGCCGACACCUACGUGUUCGUGGGCAGCAGCAACU ACAGCAAGAAGUUCAAGCCCGAGAUCGCCAUCCGGCCCAAG GUGCGGGACCAGGAGGGCCGGAUGAACUACUACUGGACCCU GGUGGAGCCUGGCGACAAGAUCACCUUCGAGGCCACCGGCA ACCUGGUGGUGCCCCGGUACGCCUUCGCCAUGGAGCGGAAC GCC | 535 |
| | Protein | MKVKLLVLLCTFTATYAGVAPLHLGKCNIAGWILGNPECESLST ASSWSNITETPSSDNGTCYPGDFIDYEELREQLSSVSSFERFEIFPK TSSWPNHSSNKGVTAACPHAGAKSFYKNLIWLVKKNGSYPKLN KSYINDSGKEVLVLWGIHHPSNSTDQQSLYQNADTYVFVGSSNY SKKFKPEIAIRPKVRDQEGRMNYYWTLVEPGDKITFEATGNLVV PRYAFAMERNA | 554 |
| RBD1-Cal09-PC | DNA | ATGAAGGTGAAGCTTCTCGTGCTCTTATGCACCTTCACCGCCA CCTACGCCGGCGTGGCTCCGCTTCACCTTGGCAAGTGCAACA TCGCCGGCTGGATCTTGGGAAACCCCGAGTGCGAGAGCAACA GCACCGCCAGCAGCTGGAGCAACATCACGGAAACCCCTAGC AGCGACAACGGCACCTGCTACCCCGGCGACTTCATCGACTAC GAGGAGCTGCGGGAGCAGCTGAGCAGCGTGAGCAGCTTCGA GCGGTTCGAGATCTTCCCCAAGACCAGCTCTTGGCCCAACCA CAGCAGCAACAAGGGCGTGACCGCCGCCTGCCCTCACGCTGG CGCCAAGAGCTTCTACAAGAACCTGATCTGGCTGGTGAAGAA GAACGGCAGCTACCCCAAGCTGAACAAGTCTTACATTAACGA CTCAGGCAAGGAGGTGCTGGTCCTGTGGGGCATCCACCACCC CAGCAACAGCACCGACCAACAGAGCCTGTACCAGAACGCCG ACACCTACGTGTTCGTGGGCAGCAGCAACTACAGCAAGAAGT TCAAGCCCGAGATCGCCATCCGGCCCAAGGTGCGGGACCAGG AGGGCCGGATGAACTACTACTGGACCCTGGTGGAGCCTGGCG ACAAGATCACCTTCGAGGCCACCGGCAACCTGGTGGTGCCCC GGTACGCCTTCGCCATGGAGCGGAACGCC | 517 |
| | mRNA | AUGAAGGUGAAGCUUCUCGUGCUCUUAUGCACCUUCACCGC CACCUACGCCGGCGUGGCUCCGCUUCACCUUGGCAAGUGCA ACAUCGCCGGCUGGAUCUUGGGAAACCCCGAGUGCGAGAGC AACAGCACCGCCAGCAGCUGGAGCAACAUCACGGAAACCCC UAGCAGCGACAACGGCACCUGCUACCCCGGCGACUUCAUCG ACUACGAGGAGCUGCGGGAGCAGCUGAGCAGCGUGAGCAGC UUCGAGCGGUUCGAGAUCUUCCCCAAGACCAGCUCUUGGCC CAACCACAGCAGCAACAAGGGCGUGACCGCCGCCUGCCCUC ACGCUGGCGCCAAGAGCUUCUACAAGAACCUGAUCUGGCUG GUGAAGAAGAACGGCAGCUACCCCAAGCUGAACAAGUCUUA CAUUAACGACUCAGGCAAGGAGGUGCUGGUCCUGUGGGGC AUCCACCACCCCAGCAACAGCACCGACCAACAGAGCCUGUA CCAGAACGCCGACACCUACGUGUUCGUGGGCAGCAGCAACU ACAGCAAGAAGUUCAAGCCCGAGAUCGCCAUCCGGCCCAAG GUGCGGGACCAGGAGGGCCGGAUGAACUACUACUGGACCCU GGUGGAGCCUGGCGACAAGAUCACCUUCGAGGCCACCGGCA ACCUGGUGGUGCCCCGGUACGCCUUCGCCAUGGAGCGGAAC GCC | 536 |
| | Protein | MKVKLLVLLCTFTATYAGVAPLHLGKCNIAGWILGNPECESNST ASSWSNITETPSSDNGTCYPGDFIDYEELREQLSSVSSFERFEIFPK TSSWPNHSSNKGVTAACPHAGAKSFYKNLIWLVKKNGSYPKLN KSYINDSGKEVLVLWGIHHPSNSTDQQSLYQNADTYVFVGSSNY SKKFKPEIAIRPKVRDQEGRMNYYWTLVEPGDKITFEATGNLVV PRYAFAMERNA | 555 |
| RBD1-Cal09 | DNA | ATGAAGGTGAAGCTTCTCGTGCTCTTATGCACCTTCACCGCCA CCTACGCCGGCGTGGCTCCGCTTCACCTTGGCAAGTGCAACA TCGCCGGCTGGATCTTGGGAAACCCCGAGTGCGAGAGCTTGA GCACCGCCAGCAGCTGGAGCAACATCACGGAAACCCCTAGC | 518 |

TABLE 26-continued

Additional Influenza mRNA Vaccine Constructs

| Name of antigen | | Open Reading Frame (ORF) Sequences | SEQ ID NO |
|---|---|---|---|
| | | AGCGACAACGGCACCTGCTACCCCGGCGACTTCATCGACTAC<br>GAGGAGCTGCGGGAGCAGCTGAGCAGCGTGAGCAGCTTCGA<br>GCGGTTCGAGATCTTCCCCAAGACCAGCTCTTGGCCCAACCA<br>CGACAGCAACAAGGGCGTGACCGCCGCCTGCCCTCACGCTGG<br>CGCCAAGAGCTTCTACAAGAACCTGATCTGGCTGGTGAAGAA<br>GGGCAACAGCTACCCCAAGCTGTCCAAGTCTTACATTAACGA<br>CAAGGGCAAGGAGGTGCTGGTCCTGTGGGGCATCCACCACCC<br>CAGCACCAGCGCCGACCAACAGAGCCTGTACCAGAACGCCG<br>ACACCTACGTGTTCGTGGGCAGCAGCCGGTACAGCAAGAAGT<br>TCAAGCCCGAGATCGCCATCCGGCCCAAGGTGCGGGACCAGG<br>AGGGCCGGATGAACTACTACTGGACCCTGGTGGAGCCTGGCG<br>ACAAGATCACCTTCGAGGCCACCGGCAACCTGGTGGTGCCCC<br>GGTACGCCTTCGCCATGGAGCGGAACGCC | |
| | mRNA | AUGAAGGUGAAGCUUCUCGUGCUCUUAUGCACCUUCACCGC<br>CACCUACGCCGGCGUGGCUCCGCUUCACCUUGGCAAGUGCA<br>ACAUCGCCGGCUGGAUCUUGGGAAACCCCGAGUGCGAGAGC<br>UUGAGCACCGCCAGCAGCUGGAGCAACAUCACGGAAACCCC<br>UAGCAGCGACAACGGCACCUGCUACCCCGGCGACUUCAUCG<br>ACUACGAGGAGCUGCGGGAGCAGCUGAGCAGCGUGAGCAGC<br>UUCGAGCGGUUCGAGAUCUUCCCCAAGACCAGCUCUUGGCC<br>CAACCACGACAGCAACAAGGGCGUGACCGCCGCCUGCCCUC<br>ACGCUGGCGCCAAGAGCUUCUACAAGAACCUGAUCUGGCUG<br>GUGAAGAAGGGCAACAGCUACCCCAAGCUGUCCAAGUCUUA<br>CAUUAACGACAAGGGCAAGGAGGUGCUGGUCCUGUGGGGC<br>AUCCACCACCCCAGCACCAGCGCCGACCAACAGAGCCUGUA<br>CCAGAACGCCGACACCUACGUGUUCGUGGGCAGCAGCCGGU<br>ACAGCAAGAAGUUCAAGCCCGAGAUCGCCAUCCGGCCCAAG<br>GUGCGGGACCAGGAGGGCCGGAUGAACUACUACUGGACCCU<br>GGUGGAGCCUGGCGACAAGAUCACCUUCGAGGCCACCGGCA<br>ACCUGGUGGUGCCCCGGUACGCCUUCGCCAUGGAGCGGAAC<br>GCC | 537 |
| | Protein | MKVKLLVLLCTFTATYAGVAPLHLGKCNIAGWILGNPECESLST<br>ASSWSNITETPSSDNGTCYPGDFIDYEELREQLSSVSSFERFEIFPK<br>TSSWPNHDSNKGVTAACPHAGAKSFYKNLIWLVKKGNSYPKLS<br>KSYINDKGKEVLVLWGIHHPSTSADQQSLYQNADTYVFVGSSR<br>YSKKFKPEIAIRPKVRDQEGRMNYYWTLVEPGDKITFEATGNLV<br>VPRYAFAMERNA | 556 |
| MRK_RBD-Cal09-PC-Cb | DNA | ATGAAGGTGAAGCTTCTCGTGCTCTTATGCACCTTCACCGCCA<br>CCTACGCCGGCGTGGCTCCGCTTCACCTTGGCAAGTGCAACA<br>TCGCCGGCTGGATCTTGGGAAACCCCGAGTGCGAGAGCTTGA<br>GCACCGCCAGCAGCTGGAGCTACATCGTGGAAACCCCTAGCA<br>GCGACAACGGCACCTGCTACCCCGGCGACTTCATCGACTACG<br>AGGAGCTGCGGGAGCAGCTGAGCAGCGTGAGCAGCTTCGAG<br>CGGTTCGAGATCTTCCCCAAGACCAGCTCTTGGCCCAACCAC<br>AGCAGCAACAAGGGCGTGACCGCCGCCTGCCCTCACGCTGGC<br>GCCAAGAGCTTCTACAAGAACCTGATCTGGCTGGTGAAGAAG<br>AACGGCAGCTACCCCAAGCTGAACAAGTCTTACATTAACGAC<br>TCAGGCAAGGAGGTGCTGGTCCTGTGGGGCATCCACCACCCC<br>AGCAACAGCACCGACCAACAGAGCCTGTACCAGAACGCCGA<br>CACCTACGTGTTCGTGGGCAGCAGCAACTACAGCAAGAAGTT<br>CAAGCCCGAGATCGCCATCCGGCCCAAGGTGCGGGACCAGG<br>AGGGCCGGATGAACTACTACTGGACCCTGGTGGAGCCTGGCG<br>ACAAGATCACCTTCGAGGCCACCGGCAACCTGGTGGTGCCCC<br>GGTACGCCTTCGCCATGGAGCGGAACGCC | 519 |
| | mRNA | AUGAAGGUGAAGCUUCUCGUGCUCUUAUGCACCUUCACCGC<br>CACCUACGCCGGCGUGGCUCCGCUUCACCUUGGCAAGUGCA<br>ACAUCGCCGGCUGGAUCUUGGGAAACCCCGAGUGCGAGAGC<br>UUGAGCACCGCCAGCAGCUGGAGCUACAUCGUGGAAACCCC<br>UAGCAGCGACAACGGCACCUGCUACCCCGGCGACUUCAUCG<br>ACUACGAGGAGCUGCGGGAGCAGCUGAGCAGCGUGAGCAGC<br>UUCGAGCGGUUCGAGAUCUUCCCCAAGACCAGCUCUUGGCC<br>CAACCACAGCAGCAACAAGGGCGUGACCGCCGCCUGCCCUC<br>ACGCUGGCGCCAAGAGCUUCUACAAGAACCUGAUCUGGCUG<br>GUGAAGAAGAACGGCAGCUACCCCAAGCUGAACAAGUCUUA<br>CAUUAACGACUCAGGCAAGGAGGUGCUGGUCCUGUGGGGC<br>AUCCACCACCCCAGCAACAGCACCGACCAACAGAGCCUGUA<br>CCAGAACGCCGACACCUACGUGUUCGUGGGCAGCAGCAACU<br>ACAGCAAGAAGUUCAAGCCCGAGAUCGCCAUCCGGCCCAAG<br>GUGCGGGACCAGGAGGGCCGGAUGAACUACUACUGGACCCU<br>GGUGGAGCCUGGCGACAAGAUCACCUUCGAGGCCACCGGCA<br>ACCUGGUGGUGCCCCGGUACGCCUUCGCCAUGGAGCGGAAC<br>GCC | 538 |
| | Protein | MKVKLLVLLCTFTATYAGVAPLHLGKCNIAGWILGNPECESLST<br>ASSWSYIVETPSSDNGTCYPGDFIDYEELREQLSSVSSFERFEIFPK | 557 |

TABLE 26-continued

Additional Influenza mRNA Vaccine Constructs

| Name of antigen | | Open Reading Frame (ORF) Sequences | SEQ ID NO |
|---|---|---|---|
| | | TSSWPNHSSNKGVTAACPHAGAKSFYKNLIWLVKKNGSYPKLN KSYINDSGKEVLVLWGIHHPSNSTDQQSLYQNADTYVFVGSSNY SKKFKPEIAIRPKVRDQEGRMNYYWTLVEPGDKITFEATGNLVV PRYAFAMERNA | |
| MRK_RBD-Cal09-PC | DNA | ATGAAGGTGAAGCTTCTCGTGCTCTTATGCACCTTCACCGCCA CCTACGCCGGCGTGGCTCCGCTTCACCTTGGCAAGTGCAACA TCGCCGGCTGGATCTTGGGAAACCCCGAGTGCGAGAGCAACA GCACCGCCAGCAGCTGGAGCTACATCGTGGAAACCCCTAGCA GCGACAACGGCACCTGCTACCCCGGCGACTTCATCGACTACG AGGAGCTGCGGGAGCAGCTGAGCAGCGTGAGCAGCTTCGAG CGGTTCGAGATCTTCCCCAAGACCAGCTCTTGGCCCAACCAC AGCAGCAACAAGGGCGTGACCGCCGCCTGCCCTCACGCTGGC GCCAAGAGCTTCTACAAGAACCTGATCTGGCTGGTGAAGAAG AACGGCAGCTACCCCAAGCTGAACAAGTCTTACATTAACGAC TCAGGCAAGGAGGTGCTGGTCCTGTGGGGCATCCACCACCCC AGCAACAGCACCGACCAACAGAGCCTGTACCAGAACGCCGA CACCTACGTGTTCGTGGGCAGCAGCAACTACAGCAAGAAGTT CAAGCCCGAGATCGCCATCCGGCCCAAGGTGCGGGACCAGG AGGGCCGGATGAACTACTACTGGACCCTGGTGGAGCCTGGCG ACAAGATCACCTTCGAGGCCACCGGCAACCTGGTGGTGCCCC GGTACGCCTTCGCCATGGAGCGGAACGCC | 520 |
| | mRNA | AUGAAGGUGAAGCUUCUCGUGCUCUUAUGCACCUUCACCGC CACCUACGCCGGCGUGGCUCCGCUUCACCUUGGCAAGUGCA ACAUCGCCGGCUGGAUCUUGGGAAACCCCGAGUGCGAGAGC AACAGCACCGCCAGCAGCUGGAGCUACAUCGUGGAAACCCC UAGCAGCGACAACGGCACCUGCUACCCCGGCGACUUCAUCG ACUACGAGGAGCUGCGGGAGCAGCUGAGCAGCGUGAGCAGC UUCGAGCGGUUCGAGAUCUUCCCCAAGACCAGCUCUUGGCC CAACCACAGCAGCAACAAGGGCGUGACCGCCGCCUGCCCUC ACGCUGGCGCCAAGAGCUUCUACAAGAACCUGAUCUGGCUG GUGAAGAAGAACGGCAGCUACCCCAAGCUGAACAAGUCUUA CAUUAACGACUCAGGCAAGGAGGUGCUGGUCCUGUGGGGC AUCCACCACCCCAGCAACAGCACCGACCAACAGAGCCUGUA CCAGAACGCCGACACCUACGUGUUCGUGGGCAGCAGCAACU ACAGCAAGAAGUUCAAGCCCGAGAUCGCCAUCCGGCCCAAG GUGCGGGACCAGGAGGGCCGGAUGAACUACUACUGGACCCU GGUGGAGCCUGGCGACAAGAUCACCUUCGAGGCCACCGGCA ACCUGGUGGUGCCCCGGUACGCCUUCGCCAUGGAGCGGAAC GCC | 539 |
| | Protein | MKVKLLVLLCTFTATYAGVAPLHLGKCNIAGWILGNPECESNST ASSWSYIVETPSSDNGTCYPGDFIDYEELREQLSSVSSFERFEIFPK TSSWPNHSSNKGVTAACPHAGAKSFYKNLIWLVKKNGSYPKLN KSYINDSGKEVLVLWGIHHPSNSTDQQSLYQNADTYVFVGSSNY SKKFKPEIAIRPKVRDQEGRMNYYWTLVEPGDKITFEATGNLVV PRYAFAMERNA | 558 |
| MRK_RBD-Cal09 | DNA | ATGAAGGTGAAGCTTCTCGTGCTCTTATGCACCTTCACCGCCA CCTACGCCGGCGTGGCTCCGCTTCACCTTGGCAAGTGCAACA TCGCCGGCTGGATCTTGGGAAACCCCGAGTGCGAGAGCTTGA GCACCGCCAGCAGCTGGAGCTACATCGTGGAAACCCCTAGCA GCGACAACGGCACCTGCTACCCCGGCGACTTCATCGACTACG AGGAGCTGCGGGAGCAGCTGAGCAGCGTGAGCAGCTTCGAG CGGTTCGAGATCTTCCCCAAGACCAGCTCTTGGCCCAACCAC GACAGCAACAAGGGCGTGACCGCCGCCTGCCCTCACGCTGGC GCCAAGAGCTTCTACAAGAACCTGATCTGGCTGGTGAAGAAG GGCAACAGCTACCCCAAGCTGTCCAAGTCTTACATTAACGAC AAGGGCAAGGAGGTGCTGGTCCTGTGGGGCATCCACCACCCC AGCACCAGCGCCGACCAACAGAGCCTGTACCAGAACGCCGA CACCTACGTGTTCGTGGGCAGCAGCCGGTACAGCAAGAAGTT CAAGCCCGAGATCGCCATCCGGCCCAAGGTGCGGGACCAGG AGGGCCGGATGAACTACTACTGGACCCTGGTGGAGCCTGGCG ACAAGATCACCTTCGAGGCCACCGGCAACCTGGTGGTGCCCC GGTACGCCTTCGCCATGGAGCGGAACGCC | 521 |
| | mRNA | AUGAAGGUGAAGCUUCUCGUGCUCUUAUGCACCUUCACCGC CACCUACGCCGGCGUGGCUCCGCUUCACCUUGGCAAGUGCA ACAUCGCCGGCUGGAUCUUGGGAAACCCCGAGUGCGAGAGC UUGAGCACCGCCAGCAGCUGGAGCUACAUCGUGGAAACCCC UAGCAGCGACAACGGCACCUGCUACCCCGGCGACUUCAUCG ACUACGAGGAGCUGCGGGAGCAGCUGAGCAGCGUGAGCAGC UUCGAGCGGUUCGAGAUCUUCCCCAAGACCAGCUCUUGGCC CAACCACGACAGCAACAAGGGCGUGACCGCCGCCUGCCCUC ACGCUGGCGCCAAGAGCUUCUACAAGAACCUGAUCUGGCUG GUGAAGAAGGGCAACAGCUACCCCAAGCUGUCCAAGUCUUA CAUUAACGACAAGGGCAAGGAGGUGCUGGUCCUGUGGGGC | 540 |

TABLE 26-continued

Additional Influenza mRNA Vaccine Constructs

| Name of antigen | | Open Reading Frame (ORF) Sequences | SEQ ID NO |
|---|---|---|---|
| | | AUCCACCACCCCAGCACCAGCGCCGACCAACAGAGCCUGUA<br>CCAGAACGCCGACACCUACGUGUUCGUGGGCAGCAGCCGGU<br>ACAGCAAGAAGUUCAAGCCCGAGAUCGCCAUCCGGCCCAAG<br>GUGCGGGACCAGGAGGGCCGGAUGAACUACUACUGGACCCU<br>GGUGGAGCCUGGCGACAAGAUCACCUUCGAGGCCACCGGCA<br>ACCUGGUGGUGCCCCGGUACGCCUUCGCCAUGGAGCGGAAC<br>GCC | |
| | Protein | MKVKLLVLLCTFTATYAGVAPLHLGKCNIAGWILGNPECESLST<br>ASSWSYIVETPSSDNGTCYPGDFIDYEELREQLSSVSSFERFEIFPK<br>TSSWPNHDSNKGVTAACPHAGAKSFYKNLIWLVKKGNSYPKLS<br>KSYINDKGKEVLVLWGIHHPSTSADQQSLYQNADTYVFVGSSR<br>YSKKFKPEIAIRPKVRDQEGRMNYYWTLVEPGDKITFEATGNLV<br>VPRYAFAMERNA | 559 |
| FLHA_PR8 | DNA | ATGAAGGCCAATTTGTTGGTCCTTCTATGTGCCCTAGCCGCCG<br>CCGACGCCGACACAATCTGCATCGGATATCACGCAAACAACA<br>GCACCGACACCGTGGATACGGTCTTGGAGAAGAACGTGACCG<br>TGACCCATTCCGTGAACCTTCTCGAGGATAGCCACAATGGCA<br>AGCTGTGTAGACTCAAGGGCATTGCCCCGCTGCAGCTGGGAA<br>AGTGCAATATTGCTGGCTGGCTGTTGGGCAACCCTGAGTGTG<br>ACCCTCTGTTACCAGTGAGATCTTGGAGCTATATCGTCGAAA<br>CCCCTAACAGCGAGAACGGCATATGCTACCCAGGCGACTTCA<br>TCGACTACGAGGAACTGCGCGAGCAGCTGAGCTCTGTGTCGA<br>GCTTCGAGCGGTTCGAGATCTTCCCTAAGGAATCTAGCTGGC<br>CTAATCATAACACAAATGGCGTTACTGCTGCCTGTAGCCACG<br>AGGGAAAGAGCAGTTTCTACCGGAATCTGTGTGGCTGACAG<br>AGAAGGAGGGCTCCTACCCTAAGCTGAAGAATAGCTATGTGA<br>ACAAGAAGGGCAAGGAGGTGCTGGTGCTGTGGGGAATACAC<br>CACCCACCTAACTCGAAGGAGCAGCAGAATCTGTACCAGAAT<br>GAGAATGCCTACGTGTCCGTCGTGACCTCCAACTACAACCGG<br>CGGTTCACGCCTGAGATCGCCGAGAGGCCTAAGGTGAGGGAC<br>CAGGCCGGACGCATGAACTACTACTGGACCCTGCTGAAGCCT<br>GGCGATACAATCATCTTCGAGGCTAATGGAAACCTGATCGCG<br>CCAATGTACGCCTTCGCCCTGTCCAGAGGATTCGGCAGCGGC<br>ATCATCACATCCAACGCCTCCATGCACGAATGCAACACCAAG<br>TGCCAGACGCCTCTGGGAGCTATCAATAGCAGCTTGCCTTAC<br>CAGAATATCCACCCTGTGACCATTGGAGAGTGTCCAAAGTAC<br>GTGCGCAGCGCAAAGCTGCGGATGGTCACAGGCCTGCGGAAT<br>ATACCTTCTATCCAGAGCCGAGGCCTGTTCGGTGCCATTGCCG<br>GCTTCATCGAGGGTGGCTGGACCGGAATGATCGACGGCTGGT<br>ATGGATACCACCACCAGAATGAACAGGGCAGCGGCTACGCC<br>GCCGATCAGAAGTCCACCCAGAACGCAATCAATGGTATCACA<br>AACAAGGTGAACACTGTAATCGAGAAGATGAACATCCAATTC<br>ACAGCCGTGGGCAAGGAGTTCAATAAGCTGGAGAAGCGGAT<br>GGAGAACCTCAACAAGAAGGTGGACGACGGCTTCCTGGATAT<br>CTGGACCTACAACGCAGAGCTGCTGGTGTTGCTGGAGAACGA<br>GAGAACCCTCGACTTCCATGATAGCAACGTTAAGAACCTATA<br>CGAGAAGGTGAAGTCACAGCTGAAGAATAACGCCAAGGAGA<br>TTTGGCAACGGCTGCTTCGAATTCTACCACAAGTGCGACAACG<br>AGTGTATGGAGAGCGTCCGGAATGGCACCTACGACTATCCTA<br>AGTATAGCGAGGAGAGCAAGCTTAATAGAGAGAAGGTCGAT<br>GGCGTGAAGCTGGAGTCAATGGGAATCTACCAGATCCTGGCT<br>ATTTATTCAACCGTGGCATCAAGTCTGGTGCTTCTGGTCAGCC<br>TGGGCGCCATCAGCTTCTGGATGTGCTCCAATGGCAGCCTGC<br>AATGCCGCATCTGCATA | 522 |
| | mRNA | AUGAAGGCCAAUUUGUUGGUCCUUCUAUGUGCCCUAGCCGC<br>CGCCGACGCCGACACAAUCUGCAUCGGAUAUCACGCAAACA<br>ACAGCACCGACACCGUGGAUACGGUCUUGGAGAAGAACGUG<br>ACCGUGACCCAUUCCGUGAACCUUCUCGAGGAUAGCCACAA<br>UGGCAAGCUGUGUAGACUCAAGGGCAUUGCCCCGCUGCAGC<br>UGGGAAAGUGCAAUAUUGCUGGCUGGCUGUUGGGCAACCC<br>UGAGUGUGACCCUCUGUUACCAGUGAGAUCUUGGAGCUAU<br>AUCGUCGAAACCCCUAACAGCGAGAACGGCAUAUGCUACCC<br>AGGCGACUUCAUCGACUACGAGGAACUGCGCGAGCAGCUGA<br>GCUCUGUGUCGAGCUUCGAGCGGUUCGAGAUCUUCCCUAAG<br>GAAUCUAGCUGGCCUAAUCAUAACACAAAUGGCGUUACUGC<br>UGCCUGUAGCCACGAGGGAAAGAGCAGUUUCUACCGGAAUC<br>UGUGUGGCUGACAGAGAAGGAGGGCUCCUACCCUAAGCUG<br>AAGAAUAGCUAUGUGAACAAGAAGGGCAAGGAGGUGCUGG<br>UGCUGUGGGGAAUACACCACCCACCUAACUCGAAGGAGCAG<br>CAGAAUCUGUACCAGAAUGAGAAUGCCUACGUGUCCGUCGU<br>GACCUCCAACUACAACCGGCGGUUCACGCCUGAGAUCGCCG<br>AGAGGCCUAAGGUGAGGGACCAGGCCGGACGCAUGAACUAC<br>UACUGGACCCUGCUGAAGCCUGGCGAUACAAUCAUCUUCGA<br>GGCUAAUGGAAACCUGAUCGCGCCAAUGUACGCCUUCGCCC | 541 |

TABLE 26-continued

Additional Influenza mRNA Vaccine Constructs

| Name of antigen | | Open Reading Frame (ORF) Sequences | SEQ ID NO |
|---|---|---|---|
| | | UGUCCAGAGGAUUCGGCAGCGGCAUCAUCACAUCCAACGCC<br>UCCAUGCACGAAUGCAACACCAAGUGCCAGACGCCUCUGGG<br>AGCUAUCAAUAGCAGCUUGCCUUACCAGAAUAUCCACCCUG<br>UGACCAUUGGAGAGUGUCCAAAGUACGUGCGCAGCGCAAA<br>GCUGCGGAUGGUCACAGGCCUGCGGAAUAUACCUUCUAUCC<br>AGAGCCGAGGCCUGUUCGGUGCCAUUGCCGGCUUCAUCGAG<br>GGUGGCUGGACCGGAAUGAUCGACGGCUGGUAUGGAUACC<br>ACCACCAGAAUGAACAGGGCAGCGGCUACGCCGCCGAUCAG<br>AAGUCCACCCAGAACGCAAUCAAUGGUAUCACAAACAAGGU<br>GAACACUGUAAUCGAGAAGAUGAACAUCCAAUUCACAGCCG<br>UGGGCAAGGAGUUCAAUAAGCUGGAGAAGCGGAUGGAGAA<br>CCUCAACAAGAAGGUGGACGACGGCUUCCUGGAUAUCUGGA<br>CCUACAACGCAGAGCUGCUGGUGUUGCUGGAGAACGAGAG<br>AACCCUCGACUUCCAUGAUAGCAACGUUAAGAACCUAUACG<br>AGAAGGUGAAGUCACAGCUGAAGAAUAACGCCAAGGAGAU<br>UGGCAACGGCUGCUUCGAAUUCUACCACAAGUGCGACAACG<br>AGUGUAUGGAGAGCGUCCGGAAUGGCACCUACGACUAUCCU<br>AAGUAUAGCGAGGAGAGCAAGCUUAAUAGAGAGAAGGUCG<br>AUGGCGUGAAGCUGGAGUCAAUGGGAAUCUACCAGAUCCU<br>GGCUAUUUAUUCAACCGUGGCAUCAAGUCUGGUGCUUCUG<br>GUCAGCCUGGGCGCCAUCAGCUUCUGGAUGUGCUCCAAUGG<br>CAGCCUGCAAUGCCGCAUCUGCAUA | |
| | Protein | MKANLLVLLCALAAADADTICIGYHANNSTDTVDTVLEKNVTV<br>THSVNLLEDSHNGKLCRLKGIAPLQLGKCNIAGWLLGNPECDPL<br>LPVRSWSYIVETPNSENGICYPGDFIDYEELREQLSSVSSFERFEIF<br>PKESSWPNHNTNGVTAACSHEGKSSFYRNLLWLTEKEGSYPKL<br>KNSYVNKKGKEVLVLWGIHHPPNSKEQQNLYQNENAYVSVVT<br>SNYNRRFTPEIAERPKVRDQAGRMNYYWTLLKPGDTIIFEANGN<br>LIAPMYAFALSRGFGSGIITSNASMHECNTKCQTPLGAINSSLPY<br>QNIHPVTIGECPKYVRSAKLRMVTGLRNIPSIQSRGLFGAIAGFIE<br>GGWTGMIDGWYGYHHQNEQGSGYAADQKSTQNAINGITNKVN<br>TVIEKMNIQFTAVGKEFNKLEKRMENLNKKVDDGFLDIWTYNA<br>ELLVLLENERTLDFHDSNVKNLYEKVKSQLKNNAKEIGNGCFEF<br>YHKCDNECMESVRNGTYDYPKYSEESKLNREKVDGVKLESMGI<br>YQILAIYSTVASSLVLLVSLGAISFWMCSNGSLQCRICI | 560 |
| FLHA_Cal09 | DNA | ATGAAGGCTATCTTGGTGGTGTTGTTGTACACATTCGCCACCG<br>CCAACGCCGACACCCTCTGCATCGGCTACCACGCGAACAATT<br>CAACCGACACCGTTGACACCGTCCTCGAGAAGAACGTGACCG<br>TGACTCATAGCGTCAACCTCCTCGAGGACAAGCATAACGGCA<br>AGCTCTGTAAGCTTAGAGGAGTGGCCCCTCTCCACCTGGGCA<br>AGTGTAACATTGCAGGCTGGATCCTGGGCAACCCTGAGTGCG<br>AGAGCCTGTCAACCGCTAGCAGCTGGAGCTACATCGTGGAAA<br>CCCCATCCAGCGATAACGGCACCTGCTACCCTGGCGATTTCA<br>TCGACTACGAGGAGCTGCGCGAGCAGTTGAGCAGCGTCTCCA<br>GCTTCGAGAGATTCGAGATCTTCCCTAAGACTAGCAGCTGGC<br>CTAATCATGACTCCAATAAGGGCGTGACGGCCGCCTGTCCTC<br>ACGCTGGAGCCAAGTCGTTCTACAAGAACCTGATCTGGCTGG<br>TAAAGAAGGGCAACAGCTACCCAAAGCTGAGCAAGTCCTAC<br>ATCAACGACAAGGGCAAGGAAGTGCTGGTGCTGTGGGGAAT<br>CCATCACCCAAGCACCTCTGCGGACCAGCAGTCTCTGTATCA<br>GAACGCCGACACCTATGTGTTCGTAGGCTCCTCCAGATACTC<br>CAAGAAGTTCAAGCCAGAGATTGCTATCCGCCCAAAGGTGCG<br>GGATCAAGAGGGTCGCATGAATTATTACTGGACCCTGGTCGA<br>GCCAGGCGATAAGATCACATTCGAAGCCACGGGAAATCTGGT<br>GGTGCCTAGATACGCTTTCGCCATGGAGAGAAACGCCGGCAG<br>CGGCATCATCATATCCGACACACCTGTGCACGACTGCAACAC<br>AACATGCCAGACGCCAAAGGGAGCCATCAACACATCTCTTCC<br>ATTCCAGAACATTCACCCAATCACAATCGGCAAGTGTCCAAA<br>GTACGTGAAGTCCACCAAGCTTAGACTGGCCACCGGCCTGCG<br>TAACATCCCTAGCATCCAGTCGAGAGGCCTCTTCGGCGCCAT<br>CGCCGGATTCATTGAAGGTGGCTGGACCGGCATGGTGGACGG<br>TTGGTATGGCTACCACCACCAGAACGAGCAGGGCAGCGGCTA<br>CGCCGCGGACCTGAAGTCCACCCAGAACGCTATTGACGAGAT<br>CACCAACAAGGTGAACAGCGTGATCGAGAAGATGAATACCC<br>AGTTCACCGCCGTCGGCAAGGAGTTCAACCATCTGGAGAAGA<br>GAATCGAGAACCTCAACAAGAAGGTCGACGACGGCTTCCTGG<br>ACATTTGGACTTACAACGCTGAGTTGTTGGTGCTTCTTGAGAA<br>TGAGCGGACCCTGGACTATCACGACTCAAATGTGAAGAACCT<br>GTACGAGAAGGTGAGATCCCAGCTGAAGAACAATGCTAAGG<br>AAATCGGCAACGGCTGCTTCGAGTTCTATCATAAGTGTGACA<br>ACACCTGCATGGAGTCTGTTAAGAACGGCACATACGACTACC<br>CGAAGTACTCTGAGGAGGCCAAGCTGAACCGAGAGGAGATA<br>GACGGCGTTAAGCTAGAAAGTACAAGGATCTACCAGATCCTT<br>GCCATCTACTCCACCGTGGCCTCCAGCCTGGTGTTGGTGGTGA | 523 |

TABLE 26-continued

Additional Influenza mRNA Vaccine Constructs

| Name of antigen | | Open Reading Frame (ORF) Sequences | SEQ ID NO |
|---|---|---|---|
| | mRNA | GCCTGGGCGCCATCAGCTTCTGGATGTGCAGTAACGGAAGCC TACAGTGCCGAATCTGCATC AUGAAGGCUAUCUUGGUGGUGUUGUUGUACACAUUCGCCA CCGCCAACGCCGACACCCUCUGCAUCGGCUACCACGCGAAC AAUUCAACCGACACCGUUGACACCGUCCUCGAGAAGAACGU GACCGUGACUCAUAGCGUCAACCUCCUCGAGGACAAGCAUA ACGGCAAGCUCUGUAAGCUUAGAGGAGUGGCCCCUCUCCAC CUGGGCAAGUGUAACAUUGCAGGCUGGAUCCUGGGCAACCC UGAGUGCGAGAGCCUGCAACCGCUAGCAGCUGGAGCUACA UCGUGGAAACCCCAUCCAGCGAUAACGGCACCUGCUACCCU GGCGAUUUCAUCGACUACGAGGAGCUGCGCGAGCAGUUGA GCAGCGUCUCCAGCUUCGAGAGAUUCGAGAUCUUCCCUAAG ACUAGCAGCUGGCCUAAUCAUGACUCCAAUAAGGGCGUGAC GGCCGCCUGUCCUCACGCUGGAGCCAAGUCGUUCUACAAGA ACCUGAUCUGGCUGGUAAAGAAGGGCAACAGCUACCCAAAG CUGAGCAAGUCCUACAUCAACGACAAGGGCAAGGAAGUGCU GGUGCUGUGGGGAAUCCAUCACCCAAGCACCUCUGCGGACC AGCAGUCUCUGUAUCAGAACGCCGACACCUAUGUGUUCGUA GGCUCCUCCAGAUACUCCAAGAAGUUCAAGCCAGAGAUUGC UAUCCGCCCAAAGGUGCGGGAUCAAGAGGGUCGCAUGAAU UAUUACUGGACCCUGGUCGAGCCAGGCGAUAAGAUCACAUU CGAAGCCACGGGAAAUCUGGUGGUGCCUAGAUACGCUUUCG CCAUGGAGAGAAACGCCGGCAGCGGCAUCAUCAUAUCCGAC ACACCUGUGCACGACUGCAACACAACAUGCCAGACGCCAAA GGGAGCCAUCAACACAUCUCUUCCAUUCCAGAACAUUCACC CAAUCACAAUCGGCAAGUGUCCAAAGUACGUGAAGUCCACC AAGCUUAGACUGGCCACCGGCCUGCGUAACAUCCCUAGCAU CCAGUCGAGAGGCCUCUUCGGCGCCAUCGCCGGAUUCAUUG AAGGUGGCUGGACCGGCAUGGUGGACGGUUGGUAUGGCUA CCACCACCAGAACGAGCAGGGCAGCGGCUACGCCGCGGACC UGAAGUCCACCCAGAACGCUAUUGACGAGAUCACCAACAAG GUGAACAGCGUGAUCGAGAAGAUGAAUACCCAGUUCACCGC CGUCGGCAAGGAGUUCAACCAUCUGGAGAAGAGAAUCGAG AACCUCAACAAGAAGGUCGACGACGGCUUCCUGGACAUUUG GACUUACAACGCUGAGUUGUUGGUGCUUCUUGAGAAUGAG CGGACCCUGGACUAUCACGACUCAAAUGUGAAGAACCUGUA CGAGAAGGUGAGAUCCCAGCUGAAGAACAAUGCUAAGGAA AUCGGCAACGGCUGCUUCGAGUUCUAUCAUAAGUGUGACA ACACCUGCAUGGAGUCUGUUAAGAACGGCACAUACGACUAC CCGAAGUACUCUGAGGAGGCCAAGCUGAACCGAGAGGAGA UAGACGGCGUUAAGCUAGAAAGUACAAGGAUCUACCAGAU CCUUGCCAUCUACUCCACCGUGGCCUCCAGCCUGGUGUUGG UGGUGAGCCUGGGCGCCAUCAGCUUCUGGAUGUGCAGUAAC GGAAGCCUACAGUGCCGAAUCUGCAUC | 542 |
| | Protein | MKAILVVLLYTFATANADTLCIGYHANNSTDTVDTVLEKNVTV THSVNLLEDKHNGKLCKLRGVAPLHLGKCNIAGWILGNPECESL STASSWSYIVETPSSDNGTCYPGDFIDYEELREQLSSVSSFERFEIF PKTSSWPNHDSNKGVTAACPHAGAKSFYKNLIWLVKKGNSYPK LSKSYINDKGKEVLVLWGIHHPSTSADQQSLYQNADTYVFVGSS RYSKKFKPEIAIRPKVRDQEGRMNYYWTLVEPGDKITFEATGNL VVPRYAFAMERNAGSGIIISDTPVHDCNTTCQTPKGAINTSLPFQ NIHPITIGKCPKYVKSTKLRLATGLRNIPSIQSRGLFGAIAGFIEGG WTGMVDGWYGYHHQNEQGSGYAADLKSTQNAIDEITNKVNSV IEKMNTQFTAVGKEFNHLEKRIENLNKKVDDGFLDIWTYNAELL VLLENERTLDYHDSNVKNLYEKVRSQLKNNAKEIGNGCFEFYH KCDNTCMESVKNGTYDYPKYSEEAKLNREEIDGVKLESTRIYQI LAIYSTVASSLVLVVSLGAISFWMCSNGSLQCRICI | 561 |
| eH1HA_d5 v1 | Protein | METPAQLLFLLLLWLPDTTGDTICIGYHANNSTDTVDTVLEKNV TVTHSVNLLEDSHNGKLCRLKGIAPLQLGKCNIAGWLLGNPECD PLPPMKSWSYIVETPNSENGICYPGDFIDYEELREQLSSVSSFERF EIFPKGSSWPNHNTNGVTAACSHEGKNSFYRNLLWLTKKEGLY PNLENSYVNKKEKEVLVLWGIHHPSNNKEQQNLYQNENAYVSV VTSNYNRRFTPEIAERPKVRDQAGRMNYYWTLLKPGDTIIFEAN GNLIAPMYAFALSRGFGSGIITSNASMHECNTKCQTPLGAINSSL PYQNIHPVTIGECPKYVRSAKLRMVTGLRNIPSIQSRGLFGAIAGF IEGGWTGMIDGWYGYHHQNEQGSGYAADQKSTQNAINGITNK VNTVIEKMNIQFTAVGKEFNKLEKRMENLNKKVDDGFLDIWTY NAELLVLLENERTLDFHDSNVKNLYEKVKSQLKNNAKEIGNGC FEFYHKCDNECMESVRNGTYDYPKYSEESKLNREKVDGVKLES MGIGSAGSAGYIPEAPRDGQAYVRKDGEWVLLSTFL | 562 |
| eH1HA_d5 v2 | Protein | METPAQLLFLLLLWLPDTTGDTICIGYHANNSTDTVDTVLEKNV TVTHSVNLLEDSHNGKLCRLKG1APLQLGKCN1AGWLLGNPECD PLPPMKSWSYIVETPNSENGICYPGDFIDYEELREQLSSVSSFERF | 563 |

TABLE 26-continued

Additional Influenza mRNA Vaccine Constructs

| Name of antigen | | Open Reading Frame (ORF) Sequences | SEQ ID NO |
|---|---|---|---|
| | | EIFPKGSSWPNHTTNGVTAACSHEGKNSFYRNLLWLTKKEGSYP NLKNSYVNKKEKEVLVLWGIHHPSNSKEQQNLYQNENAHVSV VTSNYNRRFTPEIAERPKVRDQAGRMNYYWTLLKPGDTIIFEAD GNLIAPMYAFALSRGFGSGIITSNASMHECNTKCQTPLGAINSSL PYQNIHPVTIGECPKYVRSAKLRMVTGLRNIPSIQSRGLFGAIAGF IEGGWTGMIDGWYGYHHQNEQGSGYAADQKSTQNAINGITNK VNTVIEKMNIQFTAVGKEFNKLEKRMENLNKKVDDGFLDIWTY NAELLVLLENERTLDFHDSNVKNLYEKVKSQLKNNAKEIGNGC FEFYHKCDNECMESVRNGTYDYPKYSEESKLNREKVDGVKLES MGIGSAGSAGYIPEAPRDGQAYVRKDGEWVLLSTFL | |
| eH1HA_d5 v3 | Protein | METPAQLLFLLLLWLPDTTGDTICIGYFIANNSTDTVDTVLEKNV TVTHSVNLLEDSHNGKLCRLKGIAPLQLGKCNIAGWLLGNPECD PLPPMKSWSYIVETPNSENGICYPGDFIDYEELREQLSSVSSFERF EIFPKGSSWPDHNTNGVTAACSHEGKNSFYRNLLWLTEKKGSYP NLKNPYVNKKEKEVLVLWGIHHPSNSKEQQNLYRNENAYVSV VTSNYNRRFTPEIAERPKVRDQAGRMNYYWTLLKPGDTIIFEAN GNLIAPMYAFALSRGFGSGIITSNASMHECNTKCQTPLGAINSSL PYQNIHPVTIGECPKYVRSAKLRMVTGLRNIPSIQSRGLFGAIAGF IEGGWTGMIDGWYGYHHQNEQGSGYAADQKSTQNAINGITNK VNTVIEKMNIQFTAVGKEFNKLEKRMENLNKKVDDGFLDIWTY NAELLVLLENERTLDFHDSNVKNLYEKVKSQLKNNAKEIGNGC FEFYHKCDNECMESVRNGTYDYPKYSEESKLNREKVDGVKLES MGIGSAGSAGYIPEAPRDGQAYVRKDGEWVLLSTFL | 564 |
| eH1HA_d5 v4 | Protein | METPAQLLFLLLLWLPDTTGDTICIGYHANNSTDTVDTVLEKNV TVTHSVNLLEDSHNGKLCKLKGIAPLQLGKCNIAGWLLGNPGC DPLLPVGSWSYIVETPNSENGICYPGDFIDYEELREQLSSVSSFER FKIFPKESSWPDHNTNGVTAACSHEGKNSFYRNLLWLTKKESSY PNLENSYVNKKRKEVLVLWGIHHPSNSKEQQNLYQNENAYVSV VTSNYNRRFTPEIAERPKVKGQAGRMNYYWTLLKPGDTIIFEAN GNLIAPMYAFALSRGFGSGIITSNASMHECNTKCQTPLGAINSSL PYQNIHPVTIGECPKYVRSAKLRMVTGLRNIPSIQSRGLFGAIAGF IEGGWTGMIDGWYGYHHQNEQGSGYAADQKSTQNAINGITNK VNTVIEKMNIQFTAVGKEFNKLEKRMENLNKKVDDGFLDIWTY NAELLVLLENERTLDFHDSNVKNLYEKVKSQLKNNAKEIGNGC FEFYHKCDNECMESVRNGTYDYPKYSEESKLNREKVDGVKLES MGIGSAGSAGYIPEAPRDGQAYVRKDGEWVLLSTFL | 565 |
| eH1HA_d5 v1 | mRNA | AUGGAGACGCCUGCUCAGCUGCUCUUUCUGCUGCUCCUGUG GUUGCCCGAUACCACUGGGGACACUAUCUGUAUCGGAUACC ACGCCAACAACUCAACCGAUACCGUGGAUACUGUCCUCGAA AAGAAUGUGACCGUUACACAUUCAGUAAAUUUGUUAGAGG AUUCUCACAAUGGGAAGCUGUGUCGACUGAAGGGGAUCGC UCCCCUGCAACUGGGGAAGUGCAACAUCGCUGGAUGGUUGC UCGGCAACCCGGAAUGCGAUCCGCUGCCACCCAUGAAGAGU UGGAGCUAUAUUGUCGAGACCCCUAACUCAGAGAACGGUA UAUGCUACCCUGGAGAUUUUAUCGAUUACGAAGAGCUGCG GGAACAGCUGAGCAGCGUCUCCAGUUUCGAACGGUUUGAA AUAUUCCCCAAGGGCAGUUCCUGGCCCAAUCACAACACUAA UGGCGUCACCGCCGCCUGCUCACACGAGGGUAAGAACUCUU UUUACCGCAAUCUGCUUUGGCUUACUAAGAAGGAAGGACU GUACCCGAAUCUGGAGAACAGUUACGUCAACAAGAAAGAG AAAGAGGUCCUGGUGCUGUGGGGAAUUCACCACCCUUCCAA UAACAAGGAACAGCAGAAUCUGUACCAAAACGAAAAUGCU UACGUGAGUGUGGUGACCUCGAACUAUAAUAGACGAUUCA CACCUGAGAUUGCCGAGCGUCCCAAAGUUAGGGACCAAGCC GGUAGGAUGAACUACUACUGGACUCUCCUGAAGCCCGGUGA CACCAUUAUCUUCGAGGCCAAUGGUAAUCUGAUCGCCCCUA UGUACGCUUUCGCACUGUCACGCGGGUUCGGAUCUGGGAUA AUUACUUCGAACGCUAGCAUGCAUGAGUGUAAUACCAAGU GCCAGACCCCACUUGGAGCAAUCAAUUCCAGCCUACCUUAU CAGAAUAUUCAUCCCGUGACCAUCGGAGAAUGCCCAAAGUA CGUUAGGUCCGCUAAACUGAGGAUGGUGACUGGCUUGAGG AACAUACCAUCUAUCCAAUCUAGGGGCCUGUUUGGCGCUAU UGCCGGGUUCAUCGAGGGUGGCUGGACAGGCAUGAUUGAC GGGUGGUACGGUUACCACCACCAGAACGAGCAGGGAUCCGG CUAUGCAGCUGACCAGAAGUCAACCCAGAACGCAAUCAACG GCAUCACAAAUAAGGUCAAUACUGUGAUCGAAAAGAUGAA CAUCCAAUUCACUGCCGUGGGCAAGGAGUUUAAUAAGCUCG AGAAGCGCAUGGAAAAUCUGAACAAAAAAGUGGACGAUGG CUUCCUGGAUAUAUGGACUUACAACGCCGAGCUCCUUGUGC UUCUGGAGAACGAACGUACCUUGGACUUUCAUGAUAGUAA CGUCAAGAAUUUGUACGAGAAGGUUAAAUCCCAGCUGAAG AACAAUGCCAAGGAAAUCGGCAACGGCUGUUUUGAAUUUU | 566 |

TABLE 26-continued

Additional Influenza mRNA Vaccine Constructs

| Name of antigen | | Open Reading Frame (ORF) Sequences | SEQ ID NO |
|---|---|---|---|
| | | ACCAUAAAUGCGACAAUGAGUGCAUGGAAUCCGUACGCAA<br>UGGGACAUACGAUUACCCUAAAUACUCCGAGGAAAGCAAGC<br>UCAACCGAGAAAAAGUGGACGGCGUCAAGCUCGAAUCAAU<br>GGGUAUUGGCAGUGCCGGAUCCGCCGGGUAUAUCCCCGAGG<br>CCCCUAGAGACGGCCAAGCCUAUGUGCGGAAAGACGGCGAA<br>UGGGUUCUGCUAUCCACCUUCUUA | |
| eH1HA_d5 v1 | 5' UTR | GGGAAAUAAGAGAGAAAAGAAGAGUAAGAAGAAAUAUAAG<br>AGCCACC | 574 |
| eH1HA_d5 v1 | 3' UTR | UGAUAAUAGGCUGGAGCCUCGGUGGCCAUGCUUCUUGCCCC<br>UUGGGCCUCCCCCCAGCCCCUCCUCCCCUUCCUGCACCCGUA<br>CCCCCGUGGUCUUUGAAUAAAGUCUGAGUGGGCGGC | 575 |
| eH1HA_d5 v1 | DNA | ATGGAGACGCCTGCTCAGCTGCTCTTTCTGCTGCTCCTGTGGT<br>TGCCCGATACCACTGGGGACACTATCTGTATCGGATACCACG<br>CCAACAACTCAACCGATACCGTGGATACTGTCCTCGAAAAGA<br>ATGTGACCGTTACACATTCAGTAAATTTGTTAGAGGATTCTCA<br>CAATGGGAAGCTGTGTCGACTGAAGGGGATCGCTCCCCTGCA<br>ACTGGGGAAGTGCAACATCGCTGGATGGTTGCTCGGCAACCC<br>GGAATGCGATCCGCTGCCACCCATGAAGAGTTGGAGCTATAT<br>TGTCGAGACCCCTAACTCAGAGAACGGTATATGCTACCCTGG<br>AGATTTTATCGATTACGAAGAGCTGCGGGAACAGCTGAGCAG<br>CGTCTCCAGTTTCGAACGGTTTGAAATATTCCCCAAGGGCAG<br>TTCCTGGCCCAATCACAACACTAATGGCGTCACCGCCGCCTG<br>CTCACACGAGGGTAAGAACTCTTTTTACCGCAATCTGCTTTGG<br>CTTACTAAGAAGGAAGGACTGTACCCGAATCTGGAGAACAGT<br>TACGTCAACAAGAAAGAGAAAGAGGTCCTGGTGCTGTGGGG<br>AATTCACCACCCTTCCAATAACAAGGAACAGCAGAATCTGTA<br>CCAAAACGAAAATGCTTACGTGAGTGTGGTGACCTCGAACTA<br>TAATAGACGATTCACACCTGAGATTGCCGAGCGTCCCAAAGT<br>TAGGGACCAAGCCGGTAGGATGAACTACTACTGGACTCTCCT<br>GAAGCCCGGTGACACCATTATCTTCGAGGCCAATGGTAATCT<br>GATCGCCCCTATGTACGCTTTCGCACTGTCACGCGGGTTCGGA<br>TCTGGGATAATTACTTCGAACGCTAGCATGCATGAGTGTAAT<br>ACCAAGTGCCAGACCCCACTTGGAGCAATCAATTCCAGCCTA<br>CCTTATCAGAATATTCATCCCGTGACCATCGGAGAATGCCCA<br>AAGTACGTTAGGTCCGCTAAACTGAGGATGGTGACTGGCTTG<br>AGGAACATACCATCTATCCAATCTAGGGGCCTGTTTGGCGCT<br>ATTGCCGGGTTCATCGAGGGTGGCTGGACAGGCATGATTGAC<br>GGGTGGTACGGTTACCACCACCAGAACGAGCAGGGATCCGG<br>CTATGCAGCTGACCAGAAGTCAACCCAGAACGCAATCAACGG<br>CATCACAAATAAGGTCAATACTGTGATCGAAAAGATGAACAT<br>CCAATTCACTGCCGTGGGCAAGGAGTTTAATAAGCTCGAGAA<br>GCGCATGGAAAATCTGAACAAAAAAGTGGACGATGGCTTCCT<br>GGATATATGGACTTACAACGCCGAGCTCCTTGTGCTTCTGGA<br>GAACGAACGTACCTTGGACTTTCATGATAGTAACGTCAAGAA<br>TTTGTACGAGAAGGTTAAATCCCAGCTGAAGAACAATGCCAA<br>GGAAATCGGCAACGGCTGTTTTGAATTTTACCATAAATGCGA<br>CAATGAGTGCATGGAATCCGTACGCAATGGGACATACGATTA<br>CCCTAAATACTCCGAGGAAAGCAAGCTCAACCGAGAAAAAG<br>TGGACGGCGTCAAGCTCGAATCAATGGGTATTGGCAGTGCCG<br>GATCCGCCGGGTATATCCCCGAGGCCCCTAGAGACGGCCAAG<br>CCTATGTGCGGAAAGACGGCGAATGGGTTCTGCTATCCACCT<br>TCTTA | 570 |
| eH1HA_d5 v2 | mRNA | AUGGAGACGCCUGCUCAGCUGCUCUUUCUGCUGCUCCUGUG<br>GUUGCCCGAUACCACUGGGGACACUAUCUGUAUCGGAUACC<br>ACGCCAACAACUCAACCGAUACCGUGGAUACUGUCCUCGAA<br>AAGAAUGUGACCGUUACACAUUCAGUAAAUUUGUUAGAGG<br>AUUCUCACAAUGGGAAGCUGUGUCGACUGAAGGGGAUCGC<br>UCCCCUGCAACUGGGGAAGUGCAACAUCGCUGGAUGGUUGC<br>UCGGCAACCCGGAAUGCGAUCCGCUGCCACCCAUGAAGAGU<br>UGGAGCUAUAUUGUCGAGACCCCUAACUCAGAGAACGGUA<br>UAUGCUACCCUGGAGAUUUUAUCGAUUACGAAGAGCUGCG<br>GGAACAGCUGAGCAGCGUCUCCAGUUUCGAACGGUUUGAA<br>AUAUUCCCCAAGGGCAGUUCCUGGCCCAAUCACAACACUAA<br>UGGCGUCACCGCCGCCUGCUCACACGAGGGUAAGAACUCUU<br>UUUACCGCAAUCUGCUUUGGCUUACUAAGAAGGAAGGAAG<br>UUACCCGAAUCUGAAAAACAGUUACGUCAACAAGAAAGAG<br>AAAGAGGUCCUGGUGCUGUGGGGAAUUCACCACCCUUCCAA<br>UUCGAAGGAACAGCAGAAUCUGUACCAAAACGAAAAUGCU<br>CACGUGAGUGUGGUGACCUCGAACUAUAAUAGACGAUUCA<br>CACCUGAGAUUGCCGAGCGUCCCAAAGUUAGGGACCAAGCC<br>GGUAGGAUGAACUACUACUGGACUCUCCUGAAGCCCGGUGA | 567 |

TABLE 26-continued

Additional Influenza mRNA Vaccine Constructs

| Name of antigen | | Open Reading Frame (ORF) Sequences | SEQ ID NO |
|---|---|---|---|
| | | CACCAUUAUCUUCGAGGCCGACGGUAAUCUGAUCGCCCCUA UGUACGCUUUCGCACUGUCACGCGGGUUCGGAUCUGGGAUA AUUACUUCGAACGCUAGCAUGCAUGAGUGUAAUACCAAGU GCCAGACCCCACUUGGAGCAAUCAAUUCCAGCCUACCUUAU CAGAAUAUUCAUCCCGUGACCAUCGGAGAAUGCCCAAAGUA CGUUAGGUCCGCUAAACUGAGGAUGGUGACUGGCUUGAGG AACAUACCAUCUAUCCAAUCUAGGGGCCUGUUUGGCGCUAU UGCCGGGUUCAUCGAGGGUGGCUGGACAGGCAUGAUUGAC GGGUGGUACGGUUACCACCACCAGAACGAGCAGGGAUCCGG CUAUGCAGCUGACCAGAAGUCAACCCAGAACGCAAUCAACG GCAUCACAAAUAAGGUCAAUACUGUGAUCGAAAAGAUGAA CAUCCAAUUCACUGCCGUGGGCAAGGAGUUUAAUAAGCUCG AGAAGCGCAUGGAAAAUCUGAACAAAAAGUGGACGAUGG CUUCCUGGAUAUAUGGACUUACAACGCCGAGCUCCUUGUGC UUCUGGAGAACGAACGUACCUUGGACUUUCAUGAUAGUAA CGUCAAGAAUUUGUACGAGAAGGUUAAAUCCCAGCUGAAG AACAUGCCAAGGAAAUCGGCAACGGCUGUUUUGAAUUUU ACCAUAAAUGCGACAAUGAGUGCAUGGAAUCCGUACGCAA UGGGACAUACGAUUACCCUAAAUACUCCGAGGAAAGCAAGC UCAACCGAGAAAAAGUGGACGGCGUCAAGCUCGAAUCAUU GGGUAUUGGCAGUGCCGGAUCCGCCGGGUAUAUCCCCGAGG CCCCUAGAGACGGCCAAGCCUAUGUGCGGAAAGACGGCGAA UGGGUUCUGCUAUCCACCUUCUUA | |
| eH1HA_d5 v2 | 5' UTR | GGGAAAUAAGAGAGAAAAGAAGAGUAAGAAGAAAUAUAAG AGCCACC | 574 |
| eH1HA_d5 v2 | 3' UTR | UGAUAAUAGGCUGGAGCCUCGGUGGCCAUGCUUCUUGCCCC UUGGGCCUCCCCCCAGCCCCUCCUCCCCUUCCUGCACCCGUA CCCCCGUGGUCUUUGAAUAAAGUCUGAGUGGGCGGC | 575 |
| eH1HA_d5 v2 | DNA | ATGGAGACGCCTGCTCAGCTGCTCTTTCTGCTGCTCCTGTGGT TGCCCGATACCACTGGGGACACTATCTGTATCGGATACCACG CCAACAACTCAACCGATACCGTGGATACTGTCCTCGAAAAGA ATGTGACCGTTACACATTCAGTAAATTTGTTAGAGGATTCTCA CAATGGGAAGCTGTGTCGACTGAAGGGGATCGCTCCCCTGCA ACTGGGGAAGTGCAACATCGCTGGATGGTTGCTCGGCAACCC GGAATGCGATCCGCTGCCACCCATGAAGAGTTGGAGCTATAT TGTCGAGACCCCTAACTCAGAGAACGGTATATGCTACCCTGG AGATTTTATCGATTACGAAGAGCTGCGGGAACAGCTGAGCAG CGTCTCCAGTTTCGAACGGTTTGAAATATTCCCCAAGGGCAG TTCCTGGCCCAATCACACCACTAATGGCGTCACCGCCGCCTG CTCACACGAGGGTAAGAACTCTTTTTACCGCAATCTGCTTTGG CTTACTAAGAAGGAAGGAAGTTACCCGAATCTGAAAAACAGT TACGTCAACAAGAAAGAAAGAGGTCCTGGTGCTGTGGGG AATTCACCACCCTTCCAATTCGAAGGAACAGCAGAATCTGTA CCAAAACGAAAATGCTCACGTGAGTGTGGTGACCTCGAACTA TAATAGACGATTCACACCTGAGATTGCCGAGCGTCCCAAAGT TAGGGACCAAGCCGGTAGGATGAACTACTGGACTCTCCT GAAGCCCGGTGACACCATTATCTTCGAGGCCGACGGTAATCT GATCGCCCCTATGTACGCTTTCGCACTGTCACGCGGGTTCGGA TCTGGGATAATTACTTCGAACGCTAGCATGCATGAGTGTAAT ACCAAGTGCCAGACCCCACTTGGAGCAATCAATTCCAGCCTA CCTTATCAGAATATTCATCCCGTGACCATCGGAGAATGCCCA AAGTACGTTAGGTCCGCTAAACTGAGGATGGTGACTGGCTTG AGGAACATACCATCTATCCAATCTAGGGGCCTGTTTGGCGCT ATTGCCGGGTTCATCGAGGGTGGCTGGACAGGCATGATTGAC GGGTGGTACGGTTACCACCACCAGAACGAGCAGGGATCCGG CTATGCAGCTGACCAGAAGTCAACCCAGAACGCAATCAACGG CATCACAAATAAGGTCAATACTGTGATCGAAAAGATGAACAT CCAATTCACTGCCGTGGGCAAGGAGTTTAATAAGCTCGAGAA GCGCATGGAAAATCTGAACAAAAAAGTGGACGATGGCTTCCT GGATATATGGACTTACAACGCCGAGCTCCTTGTGCTTCTGGA GAACGAACGTACCTTGGACTTTCATGATAGTAACGTCAAGAA TTTGTACGAGAAGGTTAAATCCCAGCTGAAGAACAATGCCAA GGAAATCGGCAACGGCTGTTTTTGAATTTTACCATAAATGCGA CAATGAGTGCATGGAATCCGTACGCAATGGGACATACGATTA CCCTAAATACTCCGAGGAAAGCAAGCTCAACCGAGAAAAAG TGGACGGCGTCAAGCTCGAATCAATGGGTATTGGCAGTGCCG GATCCGCCGGGTATATCCCCGAGGCCCCTAGAGACGGCCAAG CCTATGTGCGGAAAGACGGCGAATGGGTTCTGCTATCCACCT TCTTA | 571 |
| eH1HA_d5 v3 | mRNA | AUGGAGACGCCUGCUCAGCUGCUCUUUCUGCUGCUCCUGUG GUUGCCCGAUACCACUGGGGACACUAUCUGUAUCGGAUACC | 568 |

TABLE 26-continued

Additional Influenza mRNA Vaccine Constructs

| Name of antigen | | Open Reading Frame (ORF) Sequences | SEQ ID NO |
|---|---|---|---|
| | | ACGCCAACAACUCAACCGAUACCGUGGAUACUGUCCUCGAA<br>AAGAAUGUGACCGUUACACAUUCAGUAAAUUUGUUAGAGG<br>AUUCUCACAAUGGGAAGCUGUGUCGACUGAAGGGGAUCGC<br>UCCCCUGCAACUGGGGAAGUGCAACAUCGCUGGAUGGUUGC<br>UCGGCAACCCGGAAUGCGAUCCGCUGCCACCCAUGAAGAGU<br>UGGAGCUAUAUUGUCGAGACCCCUAACUCAGAGAACGGUA<br>UAUGCUACCCUGGAGAUUUUAUCGAUUACGAAGAGCUGCG<br>GGAACAGCUGAGCAGCGUCUCCAGUUUCGAACGGUUUGAA<br>AUAUUCCCCAAGGGCAGUUCCUGGCCCGACCACAACACUAA<br>UGGCGUCACCGCCGCCUGCUCACACGAGGGUAAGAACUCUU<br>UUUACCGCAAUCUGCUUUGGCUUACUGAGAAGAAGGGAAG<br>UUACCCGAAUCUGAAAAACCCCUACGUCAACAAGAAAGAGA<br>AAGAGGUCCUGGUGCUGUGGGGAAUUCACCACCCUUCCAAU<br>UCGAAGGAACAGCAGAAUCUGUACAGAAACGAAAAUGCUU<br>ACGUGAGUGUGGUGACCUCGAACUAUAAUAGACGAUUCAC<br>ACCUGAGAUUGCCGAGCGUCCCAAAGUUAGGGACCAAGCCG<br>GUAGGAUGAACUACUACUGGACUCUCCUGAAGCCCGGUGAC<br>ACCAUUAUCUUCGAGGCCAAUGGUAAUCUGAUCGCCCCUAU<br>GUACGCUUUCGCACUGUCACGCGGGUUCGGAUCUGGGAUAA<br>UUACUUCGAACGCUAGCAUGCAUGAGUGUAAUACCAAGUG<br>CCAGACCCCACUUGGAGCAAUCAAUUCCAGCCUACCUUAUC<br>AGAAUAUUCAUCCCGUGACCAUCGGAGAAUGCCCAAAGUAC<br>GUUAGGUCCGCUAAACUGAGGAUGGUGACUGGCUUGAGGA<br>ACAUACCAUCUAUCCAAUCUAGGGGCCUGUUUGGCGCUAUU<br>GCCGGGUUCAUCGAGGGUGGCUGGACAGGCAUGAUUGACG<br>GGUGGUACGGUUACCACCACCAGAACGAGCAGGGAUCCGGC<br>UAUGCAGCUGACCAGAAGUCAACCCAGAACGCAAUCAACGG<br>CAUCACAAAUAAGGUCAAUACUGUGAUCGAAAAGAUGAAC<br>AUCCAAUUCACUGCCGUGGGCAAGGAGUUUAAUAAGCUCG<br>AGAAGCGCAUGGAAAAUCUGAACAAAAAAGUGGACGAUGG<br>CUUCCUGGAUAUAUGGACUUACAACGCCGAGCUCCUUGUGC<br>UUCUGGAGAACGAACGUACCUUGGACUUUCAUGAUAGUAA<br>CGUCAAGAAUUUGUACGAGAAGGUUAAAUCCCAGCUGAAG<br>AACAAUGCCAAGGAAAUCGGCAACGGCUGUUUUGAAUUUU<br>ACCAUAAAUGCGACAAUGAGUGCAUGGAAUCCGUACGCAA<br>UGGGACAUACGAUUACCCUAAAUACUCCGAGGAAAGCAAGC<br>UCAACCGAGAAAAAGUGGACGGCGUCAAGCUCGAAUCAAU<br>GGGUAUUGGCAGUGCCGGAUCCGCCGGGUAUAUCCCCGAGG<br>CCCCUAGAGACGGCCAAGCCUAUGUGCGGAAAGACGGCGAA<br>UGGGUUCUGCUAUCCACCUUCUUA | |
| eH1HA_d5 v3 | 5' UTR | GGGAAAUAAGAGAGAAAAGAAGAGUAAGAAGAAAUAUAAG<br>AGCCACC | 574 |
| eH1HA_d5 v3 | 3' UTR | UGAUAAUAGGCUGGAGCCUCGGUGGCCAUGCUUCUUGCCCC<br>UUGGGCCUCCCCCCAGCCCCUCCUCCCCUUCCUGCACCCGUA<br>CCCCCGUGGUCUUUGAAUAAAGUCUGAGUGGGCGGC | 575 |
| eH1HA_d5 v3 | DNA | ATGGAGACGCCTGCTCAGCTGCTCTTTCTGCTGCTCCTGTGGT<br>TGCCCGATACCACTGGGGACACTATCTGTATCGGATACCACG<br>CCAACAACTCAACCGATACCGTGGATACTGTCCTCGAAAAGA<br>ATGTGACCGTTACACATTCAGTAAATTTGTTAGAGGATTCTCA<br>CAATGGGAAGCTGTGTCGACTGAAGGGGATCGCTCCCCTGCA<br>ACTGGGGAAGTGCAACATCGCTGGATGGTTGCTCGGCAACCC<br>GGAATGCGATCCGCTGCCACCCATGAAGAGTTGGAGCTATAT<br>TGTCGAGACCCCTAACTCAGAGAACGGTATATGCTACCCTGG<br>AGATTTTATCGATTACGAAGAGCTGCGGGAACAGCTGAGCAG<br>CGTCTCCAGTTTCGAACGGTTTGAAATATTCCCCAAGGGCAG<br>TTCCTGGCCCGACCACAACACTAATGGCGTCACCGCCGCCTG<br>CTCACACGAGGGTAAGAACTCTTTTTACCGCAATCTGCTTTGG<br>CTTACTGAGAAGAAGGGAAGTTACCCGAATCTGAAAAACCCC<br>TACGTCAACAAGAAAGAGAAAGAGGTCCTGGTGCTGTGGGG<br>AATTCACCACCCTTCCAATTCGAAGGAACAGCAGAATCTGTA<br>CAGAAACGAAAATGCTTACGTGAGTGTGGTGACCTCGAACTA<br>TAATAGACGATTCACACCTGAGATTGCCGAGCGTCCCAAAGT<br>TAGGGACCAAGCCGGTAGGATGAACTACTACTGGACTCTCCT<br>GAAGCCCGGTGACACCATTATCTTCGAGGCCAATGGTAATCT<br>GATCGCCCCTATGTACGCTTTCGCACTGTCACGCGGGTTCGGA<br>TCTGGGATAATTACTTCGAACGCTAGCATGCATGAGTGTAAT<br>ACCAAGTGCCAGACCCCACTTGGAGCAATCAATTCCAGCCTA<br>CCTTATCAGAATATTCATCCCGTGACCATCGGAGAATGCCCA<br>AAGTACGTTAGGTCCGCTAAACTGAGGATGGTGACTGGCTTG<br>AGGAACATACCATCTATCCAATCTAGGGGCCTGTTTGGCGCT<br>ATTGCCGGGTTCATCGAGGGTGGCTGGACAGGCATGATTGAC<br>GGGTGGTACGGTTACCACCACCAGAACGAGCAGGGATCCGG | 572 |

TABLE 26-continued

Additional Influenza mRNA Vaccine Constructs

| Name of antigen | | Open Reading Frame (ORF) Sequences | SEQ ID NO |
|---|---|---|---|
| | | CTATGCAGCTGACCAGAAGTCAACCCAGAACGCAATCAACGG CATCACAAATAAGGTCAATACTGTGATCGAAAAGATGAACAT CCAATTCACTGCCGTGGGCAAGGAGTTTAATAAGCTCGAGAA GCGCATGGAAAATCTGAACAAAAAGTGGACGATGGCTTCCT GGATATATGGACTTACAACGCCGAGCTCCTTGTGCTTCTGGA GAACGAACGTACCTTGGACTTTCATGATAGTAACGTCAAGAA TTTGTACGAGAAGGTTAAATCCCAGCTGAAGAACAATGCCAA GGAAATCGGCAACGGCTGTTTTGAATTTTACCATAAATGCGA CAATGAGTGCATGGAATCCGTACGCAATGGGACATACGATTA CCCTAAATACTCCGAGGAAAGCAAGCTCAACCGAGAAAAAG TGGACGGCGTCAAGCTCGAATCAATGGGTATTGGCAGTGCCG GATCCGCCGGGTATATCCCCGAGGCCCCTAGAGACGGCCAAG CCTATGTGCGGAAAGACGGCGAATGGGTTCTGCTATCCACCT TCTTA | |
| eH1HA_d5 v4 | mRNA | AUGGAGACGCCUGCUCAGCUGCUCUUUCUGCUGCUCCUGUG GUUGCCCGAUACCACUGGGGACACUAUCUGUAUCGGAUACC ACGCCAACAACUCAACCGAUACCGUGGAUACUGUCCUCGAA AAGAAUGUGACCGUUACACAUUCAGUAAAUUUGUUAGAGG AUUCUCACAAUGGGAAGCUGUGUAAGCUGAAGGGGAUCGC UCCCCUGCAACUGGGGAAGUGCAACAUCGCUGGAUGGUUGC UCGGCAACCCGGGCUGCGAUCCGCUGCUGCCCGUUGGCAGU UGGAGCUAUAUUGUCGAGACCCCUAACUCAGAGAACGGUA UAUGCUACCCUGGAGAUUUUAUCGAUUACGAAGAGCUGCG GGAACAGCUGAGCAGCGUCUCCCAGUUUCGAACGGUUUAAG AUAUUCCCCAAGGAGAGUUCCUGGCCCGACCACAACACUAA UGGCGUCACCGCCGCCUGCUCACACGAGGGUAAGAACUCUU UUUACCGCAAUCUGCUUUGGCUUACUAAGAAGGAAAGCAG UUACCCGAAUCUGGAGAACAGUUACGUCAACAAGAAACGG AAAGAGGUCCUGGUGCUGUGGGGAAUUCACCACCCUUCCAA UUCGAAGGAACAGCAGAAUCUGUACCAAAACGAAAAUGCU UACGUGAGUGUGGUGACCUCGAACUAUAAUAGACGAUUCA CACCUGAGAUUGCCGAGCGUCCCAAAGUUAAGGGCCAAGCC GGUAGGAUGAACUACUACUGGACUCUCCUGAAGCCCGGUGA CACCAUUAUCUUCGAGGCCAAUGGUAAUCUGAUCGCCCCUA UGUACGCUUUCGCACUGUCACGCGGGUUCGGAUCUGGGAUA AUUAUCUUCGAACGCUAGCAUGCAUGAGUGUAAUACCAAGU GCCAGACCCCACUUGGAGCAAUCAAUUCCAGCCUACCUUAU CAGAAUAUUCAUCCCGUGACCAUCGGAGAAUGCCCAAAGUA CGUUAGGUCCGCUAAACUGAGGAUGGUGACUGGCUUGAGG AACAUACCAUCUAUCCAAUCUAGGGGCCUGUUUGGCGCUAU UGCCGGGUUCAUCGAGGGUGGCUGGACAGGCAUGAUUGAC GGGUGGUACGGUUACCACCACCAGAACGAGCAGGGAUCCGG CUAUGCAGCUGACCAGAAGUCAACCCAGAACGCAAUCAACG GCAUCACAAAUAAGGUCAAUACUGUGAUCGAAAAGAUGAA CAUCCAAUUCACUGCCGUGGGCAAGGAGUUUAAUAAGCUCG AGAAGCGCAUGGAAAAUCUGAACAAAAAGUGGACGAUGG CUUCCUGGAUAUAUGGACUUACAACGCCGAGCUCCUUGUGC UUCUGGAGAACGAACGUACCUUGGACUUUCAUGAUAGUAA CGUCAAGAAUUUGUACGAGAAGGUUAAAUCCCAGCUGAAG AACAAUGCCAAGGAAAUCGGCAACGGCUGUUUUGAAUUUU ACCAUAAAUGCGACAAUGAGUGCAUGGAAUCCGUACGCAA UGGGACAUACGAUUACCCUAAAUACUCCGAGGAAAGCAAGC UCAACCGAGAAAAAGUGGACGGCGUCAAGCUCGAAUCAAU GGGUAUUGGCAGUGCCGGAUCCGCCGGGUAUAUCCCCGAGG CCCCUAGAGACGGCCAAGCCUAUGUGCGGAAAGACGGCGAA UGGGUUCUGCUAUCCACCUUCUUA | 569 |
| eH1HA_d5 v4 | 5' UTR | GGGAAAUAAGAGAGAAAAGAAGAGUAAGAAGAAAUAUAAG AGCCACC | 574 |
| eH1HA_d5 v4 | 3' UTR | UGAUAAUAGGCUGGAGCCUCGGUGGCCAUGCUUCUUGCCCC UUGGGCCUCCCCCCAGCCCCUCCUCCCCUUCCUGCACCCGUA CCCCCGUGGUCUUUGAAUAAAGUCUGAGUGGGCGGC | 575 |
| eH1HA_d5 v4 | DNA | ATGGAGACGCCTGCTCAGCTGCTCTTTCTGCTGCTCCTGTGGT TGCCCGATACCACTGGGGACACTATCTGTATCGGATACCACG CCAACAACTCAACCGATACCGTGGATACTGTCCTCGAAAAGA ATGTGACCGTTACACATTCAGTAAATTTGTTAGAGGATTCTCA CAATGGGAAGCTGTGTAAGCTGAAGGGGATCGCTCCCCTGCA ACTGGGGAAGTGCAACATCGCTGGATGGTTGCTCGGCAACCC GGGCTGCGATCCGCTGCTGCCCGTTGGCAGTTGGAGCTATAT TGTCGAGACCCCTAACTCAGAGAACGGTATATGCTACCCTGG AGATTTTATCGATTACGAAGAGCTGCGGGAACAGCTGAGCAG CGTCTCCAGTTTCGAACGGTTTAAGATATTCCCCAAGGAGAG | 573 |

TABLE 26-continued

| Additional Influenza mRNA Vaccine Constructs | | |
|---|---|---|
| Name of antigen | Open Reading Frame (ORF) Sequences | SEQ ID NO |
| | TTCCTGGCCCGACCACAACACTAATGGCGTCACCGCCGCCTG CTCACACGAGGGTAAGAACTCTTTTTACCGCAATCTGCTTTGG CTTACTAAGAAGGAAAGCAGTTACCCGAATCTGGAGAACAGT TACGTCAACAAGAAACGGAAAGAGGTCCTGGTGCTGTGGGG AATTCACCACCCTTCCAATTCGAAGGAACAGCAGAATCTGTA CCAAAACGAAAATGCTTACGTGAGTGTGGTGACCTCGAACTA TAATAGACGATTCACACCTGAGATTGCCGAGCGTCCCAAAGT TAAGGGCCAAGCCGGTAGGATGAACTACTACTGGACTCTCCT GAAGCCCGGTGACACCATTATCTTCGAGGCCAATGGTAATCT GATCGCCCCTATGTACGCTTTCGCACTGTCACGCGGGTTCGGA TCTGGGATAATTACTTCGAACGCTAGCATGCATGAGTGTAAT ACCAAGTGCCAGACCCCACTTGGAGCAATCAATTCCAGCCTA CCTTATCAGAATATTCATCCCGTGACCATCGGAGAATGCCCA AAGTACGTTAGGTCCGCTAAACTGAGGATGGTGACTGGCTTG AGGAACATACCATCTATCCAATCTAGGGGCCTGTTTGGCGCT ATTGCCGGGTTCATCGAGGGTGGCTGGACAGGCATGATTGAC GGGTGGTACGGTTACCACCACCAGAACGAGCAGGGATCCGG CTATGCAGCTGACCAGAAGTCAACCCAGAACGCAATCAACGG CATCACAAATAAGGTCAATACTGTGATCGAAAAGATGAACAT CCAATTCACTGCCGTGGGCAAGGAGTTTAATAAGCTCGAGAA GCGCATGGAAAATCTGAACAAAAAAGTGGACGATGGCTTCCT GGATATATGGACTTACAACGCCGAGCTCCTTGTGCTTCTGGA GAACGAACGTACCTTGGACTTTCATGATAGTAACGTCAAGAA TTTGTACGAGAAGGTTAAATCCCAGCTGAAGAACAATGCCAA GGAAATCGGCAACGGCTGTTTTGAATTTTACCATAAATGCGA CAATGAGTGCATGGAATCCGTACGCAATGGGACATACGATTA CCCTAAATACTCCGAGGAAAGCAAGCTCAACCGAGAAAAAG TGGACGGCGTCAAGCTCGAATCAATGGGTATTGGCAGTGCCG GATCCGCCGGGTATATCCCCGAGGCCCCTAGAGACGGCCAAG CCTATGTGCGGAAAGACGGCGAATGGGTTCTGCTATCCACCT TCTTA | |

It should be understood that the 5' and/or 3' UTR for each construct may be omitted, modified or substituted for a different UTR sequences in any one of the vaccines as provided herein.

EQUIVALENTS

Those skilled in the art will recognize, or be able to ascertain using no more than routine experimentation, many equivalents to the specific embodiments of the disclosure described herein. Such equivalents are intended to be encompassed by the following claims.

All references, including patent documents, disclosed herein are incorporated by reference in their entirety.

SEQUENCE LISTING (575 sequences)

SEQ ID NO: 1 - protein, 349 aa, Influenza A virus
ACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIITNGATSACRRSGSSFYAEMKWLLSNSDNAAFPQMTKSYRNPRNKPALIVWGIHHSGSTTEQTKLYGSGNKLITVESSKYQQSFTPSPGARPQVNGESGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIEKDGGSHYG

SEQ ID NO: 2 - protein, 560 aa, Influenza A virus
MNTQILVFALVAIIPINADKICLGHHAVSNGTKVNTLTERGVEVVNATETVERTNVPRICSRGKRTVDLGQCGLLGTITGPPQCDQFLEFSADLIIERREGSDVCYPGKFVNEEALRQILRESGGIDKETMGFTYSGIRTNGAPSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 3 - protein, 560 aa, Influenza A virus
MNTQILVFIACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIRTNGATSACRRSGSSFYAEMKWLLSNSDNAAFPQMTKSYRNPRNKPALIVWGIHHSGSTTEQTKLYGSGNKLITVGSSKYQQSFTPSPGARPQVNGQSGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIENGWEGLIDGWYGFKHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRRQLRENAEEDGTGCFEIFHKCDDQCMESIRNNTYDHAQYRAESLQNRIQIDPVKLSSGYKDIILWFSFGASCFLLLAIAMGLVFICIKNGNMRCTICI

SEQ ID NO: 4 - protein, 560 aa, Influenza A virus
MNTQILALIACMLIGAKGDKICLGHHAVANGTKVNTLTERGIEVVNATETVETANIKKICTQGKRPTDLGQCGLLGTLIGPPQCDQFLEFDTDLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVRLSSGYKDIILWFSFGASCFLLLAIAMGLVFICIKNGNMRCTICI

SEQ ID NO: 5 - protein, 560 aa, Influenza A virus
MNTQILAFIACMLVGVRGDKICLGHHAVANGTKVNTLTEKGIEVVNATETVESANIKKICTQGKRPTDLGQCGLLGTLIGPPQCDQFLEFDSDLIIERREGTDVCYPGKFTNEESLRQILRGSGGIDKESMGFTYSGIRTNGATSACRRLGSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGIQSDVPLDSSCGGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELMDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLIFICIKNGNMRCTICI

SEQ ID NO: 6 - protein, 560 aa, Influenza A virus
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIGKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRTVGKCPRYVKQESLLLATGMKNVPEIPKGRGLFGAIAGFIENGWEGLIDGWYGFRHQNAQGEGTAADYKSTQSAIDQITGKLNRLIERTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSNGYKDVILWFSFGASCFILLAIAMGLVFICVKNGNMRCTICI

SEQ ID NO: 7 - protein, 560 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGTIISNLPFQNINSRAVGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 8 - protein, 560 aa, Influenza A virus
MNIQILVFALVAIIPTNADKICLGHHAVSNGTKVNTLTERGVEVVNATETVERTNVPRICSKGKRTVDLGQCGLLGTITGPPQCDQFLEFSADLIIERRGGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLKGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 9 - protein, 404 aa, Influenza A virus
MNTQILVFIACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIRTNGATSACRRSGSSFYAEMKWLLSNSDNAAFPQMTKSYRNPRNKPALIVWGIHHSGSTTEQTKLYGSGNKLITVGSSKYQQSFTPSPGARPQVNGQSGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIENGWEGLIDGWYGFKHQNAQGEGTAADYKSTQSAIDQITGKLNRLIDKTNQQFEL

SEQ ID NO: 10 - protein, 160 aa, Influenza A virus
STQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILL

SEQ ID NO: 11 - protein, 560 aa, Influenza A virus
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSSYAEMKWLLSNSDNAAFPQMTKSYRNPRNKPALIIWGVHHSGSATEQTKLYGSGNKLITVGSSKYQQSFTPSPGTRPQVNGQSGRIDFHWLLLDPNDTVTFTFNGAFIAPDRASFLRGKSLGIQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQHFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 12 - protein, 560 aa, Influenza A virus
  misc_feature (47)..(47): Xaa can be any naturally occurring amino acid
MNTQILALIACMLIGAKGDKICLGHHAVANGTKVNTLTERGIEVVNXTETVETANIKKICTHGKRPTDLGQCGLLGTLIGPPQCDRFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGTRPQVNGQSGRIDFHWLLLDPNDTVTFTFNGAFIAPDRASFLRGKSLGIQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 13 - protein, 560 aa, Influenza A virus
  misc_feature (143)..(143): Xaa can be any naturally occurring amino acid
MNIQILVFALVAIIPTNADKICLGHHAVSNGTKVNTLTERGVEVVNATETVERTNVPRICSKGKRTVDLGQCGLLGTITGPPQCDQFLEFSADLIIERRGGSDVCYPGKFVNEEALRQILRESGGIDKETMGFTYSGIRTNGXTSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLKGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 14 - protein, 303 aa, Influenza A virus
PAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 15 - protein, 556 aa, Influenza A virus
ILVFALVAIIPTNANKIGLGHHAVSNGTKVNTLTERGVEVFNATETVERTNVPRICSKGKKTVDLGQCGLRGTITGPPQCDQFLKFSPDLIIERQKGSDVCYPGKFVNEKPLRQILRESGGIDKETMGFAYNGIKTNGPPIACRKSGSSFYAKMKWLLSNTDKAAFPQMTKSYKNTRRNPALIVWGIHHSGSTTKQTKLYGIGSNLITVGSSNYQQSFVPSPGARPQVNGQSGRIDFHWLILNPNDTVTFSFNGAFIPPDRASFLRGKSMGIQSGVQVDASCEGDCYHSGGTIISNLPFQNINSRAVGKCPRYVKQESLMLATGMKNVPELPKGKGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 16 - protein, 556 aa, Influenza A virus
ILVFALVAIIPTNANKIGLGHHAVSNGTKVNTLTERGVEFFNATETVEPTNVPRICSKGKKTVDLGQCGLLGTITGPPQCDQFLEFSADLIIERREGSDVCYPGKFVNEKALRQILRESGGIDKETMGFAYSGIKTNGPPIACRKSGSSFYAKMKWLLSNTDKAAFPQMTKSYKNIRRDPALIVWGIHHSGSTTKQTNLYGIGSNLITVGSSNYQQSFVPSPGARPQVNGQSGRIDFHWLILNPNDTVTFIFNGAFIAPDRASFLIGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 17 - protein, 555 aa, Influenza A virus
LVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMARIRNNTYDHSKYREEAMQNRIQIDPVKLSSGYKDVILWFSFGASCFILLAIAMGLVFICVKNGNMRCTICI

SEQ ID NO: 18 - protein, 555 aa, Influenza A virus
SILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGSIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTI

SEQ ID NO: 19 - protein, 557 aa, Influenza A virus
QILAFIACMLIGAKGDKICLGHHAVANGTKVNTLTERGIEVVNATETVETVNIKKICTQGKRPTDLGQCGLLGTLIGPPQCDQFLEFDADLIIERRKGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFVPSPGARPQVNGQSGRIDFHWLLLDPNDTVTFTFNGAFIAPERASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQINPVKLSSGYKDIILWFSFGASCFLLLAIAMGLVFICIKNGNMRCTICI

SEQ ID NO: 20 - protein, 560 aa, Influenza A virus
MNTQILALIACMLIGAKGDKICLGHHAVANGTKVNTLTERRIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 21 - protein, 560 aa, Influenza A virus
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIVWGVHHSASATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 22 - protein, 560 aa, Influenza A virus
MNTQILAFIACMLIGINGDKICLGHHAVANGTKVNTLTERGIEVVNATETVETANIKRICTQGKRPIDLGQCGLLGTLIGPPQCDQFLEFDSDLIIERREGTDVCYPGKFTNEESLRQILRGSGGIDKESMGFTYSGIRTNGATSACIRLGSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGVQSDVPLDSSCGGDCFHSGGTIVSSLPFQNINPRTVGRCPRYVKQTSLLLATGMKNVPENPKTRGLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 23 - protein, 560 aa, Influenza A virus
MNTQILTLIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHNGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 24 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGISGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 25 - protein, 560 aa, Influenza A virus
MNTQILVFALIAIIPANADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCHHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 26 - protein, 560 aa, Influenza A virus
MNTQILVFALIAIIPTNADKICLGHHAVSNGTKVNTLTERGGEVVNATETVERTNIPRICSKGKKTVDLGQGGPRGTITGPPQCDQFLEFSADLIMERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 27 - protein, 560 aa, Influenza A virus
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 28 - protein, 560 aa, Influenza A virus
MNTQVLVFALMAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRRDPALIAWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDDTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 29 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQITKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 30 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 31 - protein, 206 aa, Influenza A virus
GMIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 32 - protein, 206 aa, Influenza A virus
GMIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 33 - protein, 549 aa, Influenza A virus
VFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMR

SEQ ID NO: 34 - protein, 552 aa, Influenza A virus
LVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 35 - protein, 196 aa, Influenza A virus
GFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 36 - protein, 193 aa, Influenza A virus
AQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 37 - protein, 192 aa, Influenza A virus
QNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 38 - protein, 191 aa, Influenza A virus
NAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 39 - protein, 193 aa, Influenza A virus
NAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTIC

SEQ ID NO: 40 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGSTSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 41 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLINGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 42 - protein, 559 aa, Influenza A virus
  misc_feature (503)..(503): Xaa can be any naturally occurring amino acid
  misc_feature (507)..(507): Xaa can be any naturally occurring amino acid
  misc_feature (509)..(509): Xaa can be any naturally occurring amino acid
  misc_feature (525)..(525): Xaa can be any naturally occurring amino acid
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYRXEAMXBXIQIDPVKLSSGYKDVXWFSFGASCFILLAIVMGLVFICVKNGNMRCTICI

SEQ ID NO: 43 - protein, 560 aa, Influenza A virus
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIGKETMGFTYSGIRTNGATSACRRSRSSFYAEMKWLLSNTDNAAFPQMTRSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRTVGKCPRYVKQESLLLATGMKNVPEIPKGRGLFGAIAGFIENGWEGLIDGWYGFRHQNAQGEGTAADYKSTQSAIDQITGKLNRLIERTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSNGYKDVILWFSFGASCFILLAIAMGLVFICVKNGNMRCTICI

SEQ ID NO: 44 - protein, 560 aa, Influenza A virus
MNTQILVFALVAIIPTNADKICLGHHAVSNGTKVNTLTERGVEVVNATETVERINVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 45 - protein, 560 aa, Influenza A virus
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 46 - protein, 560 aa, Influenza A virus
  misc_feature (215)..(215): Xaa can be any naturally occurring amino acid
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGXSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 47 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEEMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 48 - protein, 560 aa, Influenza A virus
  misc_feature (510)..(521): Xaa can be any naturally occurring amino acid
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDRSKYREEAMQNRXXXXXXXXXXXXKDVILWFSFGASCFILLAIVMGLVFICVKNGNMRCTICI

SEQ ID NO: 49 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 50 - protein, 560 aa, Influenza A virus
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIKNNTYDHSKYREEAMQNRIQIDPVKLSSGYKDVILWFSFGASCFILLAIVMGLVFICVKNGNMRCTICI

SEQ ID NO: 51 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 52 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVRRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 53 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDNRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 54 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSEIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 55 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTITFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 56 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 57 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 58 - protein, 553 aa, Influenza A virus
  misc_feature (72)..(72): Xaa can be any naturally occurring amino acid
  misc_feature (137)..(137): Xaa can be any naturally occurring amino acid
FALVAIIPINADKICLGHHAVSNGTKVNTLTERGVEVVNATETVERTNVPRICSRGKRTVDLGQCGLLGTIXGPPQCDQFLEFSADLIIERREGSDVCYPGKFVNEEALRQILRESGGIDKETMGFTYSGIRTNGAXSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 59 - protein, 560 aa, Influenza A virus
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 60 - protein, 560 aa, Influenza A virus
MNTQILALIACMLVGTKGDKICLGHHAVANGTKVNTLTERGIEVVNATETVETANIKKICTQGKRPTDLGQCGLLGTLIGPPQCDQFLEFDADLIIERREGTDVCYPGKFTNEEPLRQILRGSGGIDKESMGFTYSGIRTNGATSTCRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFEMIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 61 - protein, 560 aa, Influenza A virus
MNTQILALIACMLVGTKGDKICLGHHAVANGTKVNTLTERGIEVVNATETVETANIKKICTQGKRPTDLGQCGLLGTLIGPPQCDQFLEFDADLIIERREGTDVCYPGKFTNEEPLRQILRGSGGIDKESMGFTYSGIRTNGATSTCRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 62 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 63 - protein, 560 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGLTYSGIRTNGATSACRRSGSSFYAEMKWLLSNTDNAAFPQMTKSYKNTRRDPALIVWGIHHSGSSTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVRLSSGYKDVILWFSFGASCFILLAIAMGLVFICVKNGNMRCTICI

SEQ ID NO: 64 - protein, 557 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGLTYSGIRTNGATSACRRSGSSFYAEMKWLLSNTDNAAFPQMTKSYKNTRRDPALIVWGIHHSGSSTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVRLSSGYKDVILWFSFGASCFILLAIAMGLVFICVKNGNMRCT

SEQ ID NO: 65 - protein, 560 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 66 - protein, 557 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCT

SEQ ID NO: 67 - protein, 558 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTI

SEQ ID NO: 68 - protein, 560 aa, Influenza A virus
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 69 - protein, 552 aa, Influenza A virus
QILVFALVAIIPTNADKICLGHHAVSNGTKVNTLTERGVEVVNATETVERTNVPRICSKGKRTVDLGQCGLLGTITGPPQCDQLLEFSADLIIERREGTDVCYPGKFVNEEALRQILRESGGIEKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMR

SEQ ID NO: 70 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGPSGRIDFHWLMLNPNDTVTFSFNGAFIAPDRASFLRGKSMGIQSGVQVDANCEGDCYHSGGTIINNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 71 - protein, 510 aa, Influenza A virus
IACMLVGAKGDKICLGHHAVANGTKVNTLTERGIEVVNATETVETANIKKLCTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTELWSYNAELLVAMENQHTIDLADSEMNKLYERVRKQLRENAEEDGTGCFEIFHKCDDQCMESIRNNTYDHTQYRTESLQNRIQIDPVKLS

SEQ ID NO: 72 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 73 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 74 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNRNMRCTICI

SEQ ID NO: 75 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 76 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 77 - protein, 560 aa, Influenza A virus
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNKRCTICI

SEQ ID NO: 78 - protein, 560 aa, Influenza A virus
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 79 - protein, 552 aa, Influenza A virus
LVFALIAIIPTNADKICLGHHAVSNGTKVNTLTERGGEVVNATETVERTNIPRICSKGKRTVDLGQCGLRGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 80 - protein, 550 aa, Influenza A virus
FALIAIIPTNADKICLGHHAVSNGTKVNTLTERGGEVVNATETVERTNFPRICSKGKRTVDLGQCGLRGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 81 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTIGI

SEQ ID NO: 82 - protein, 552 aa, Influenza A virus
ALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSRSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIMSNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 83 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKNPALIVWGIHHSGSTAEQTKLYGSGNKLVTVGSSNYQQSFAPSPGARTQVNGQSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 84 - protein, 560 aa, Influenza A virus
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGETSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITNKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 85 - protein, 560 aa, Influenza A virus
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITSKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 86 - protein, 549 aa, Influenza A virus
TQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPPVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKN

SEQ ID NO: 87 - protein, 560 aa, Influenza A virus
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITSKLNRLIDKTNQQFELIDNEFSEIEQQIGNVINWTRDSMTEVWSYNAELLVAMENQHTIDLADSEMNKLYERVRKQLRENAEEDGTGCFEIFHNCDDQCMESIRNNTYDHTQYRKESLQNRIQIDPVKLSSGYKDIILWFSFGASCFLLLAIAMGLVFICIKNGNMRCTICI

SEQ ID NO: 88 - protein, 560 aa, Influenza A virus
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNDAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 89 - protein, 554 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNM

SEQ ID NO: 90 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 91 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIMSNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 92 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 93 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVSSPGARPQVNGLSGRIDFHWLMLNPNDTVTFSFNGAFIAPDRASFLRGKSMGIQSGVQVDANCKGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 94 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDICYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLKGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 95 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 96 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVKEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 97 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 98 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 99 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTDGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 100 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGERPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 101 - protein, 560 aa, Influenza A virus
MNTQILVFALVAIIPINADKICLGHHAVSNGTKVNTLTERGVEVVNATETVERTNVPRICSRGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 102 - protein, 560 aa, Influenza A virus
MNTQILAFIACMLVGAKGDKICLGHHAVANGTKVNTLTERGIEVVNATETVETANIKKLCTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTELWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 103 - protein, 561 aa, Influenza A virus
MNTQILAFIACMLVGVRGDKICLGHHAVANGTKVNTLTEKGIEVVNATETVESANIKKICTQGKRPTDLGQCGLLGTLIGPPQCDQFLEFDSDLIIERREGTDVCYPGKFTNEESLRQILRGSGGIDKESMGFTYSGIRTNGATSACRRLGSSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGIQSDVPLDSSCGGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELMDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLIFICIKNGNMRCTICI

SEQ ID NO: 104 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQISNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 105 - protein, 560 aa, Influenza A virus
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 106 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVEVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 107 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDMILWFSFGASCFILLAIVMGLVFICVKNGNMRCTICI

SEQ ID NO: 108 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 109 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 110 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 111 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 112 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 113 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 114 - protein, 560 aa, Influenza A virus
MNTQILVFALTAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 115 - protein, 560 aa, Influenza A virus
MNTQILVFALIAIIPTNADKICLGHHAVPNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 116 - protein, 560 aa, Influenza A virus
  misc_feature (183)..(183): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKXPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 117 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYRNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 118 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDNRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 119 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 120 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 121 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 122 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 123 - protein, 560 aa, Influenza A virus
MNTQILVFALIAIIPTNADKICLGHHAVSNGTKVNTLTERGVEVVNATETVERTNIPRICSKGKKTIDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHNKYREEAMQNRIQIDPVKLSSGYKDVILWFSFGASCFILLAIVMGLVFICVKNGNMRCTICI

SEQ ID NO: 124 - protein, 560 aa, Influenza A virus
MNTQILVFALIAIIPTNADKICLGHHAVSNGTKINTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 125 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 126 - protein, 560 aa, Influenza A virus
MNTQILVFALVAIIPTNADKICLGHHAVSNGTKVNTLTERGVEVVNATETVERTNIPRICSKGKKTVDLGQCGLLGTITGPPQCDQFLEFSADLIVERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPLVNGQSGRIDFHWLMLNPNDTVTFSFNGAFIAPDRASFLRGKSMGIQSGVQVDANCEGDCYHSGGTIISNLPFQNINSRAVGKCPRYVKQESLLLATGMKNVPEVPKGRGLFGAIAGFIENGWEGLIDGWYGFRHQNAQGEGTAADYKSTQSAIDQVTGKLNRLIEKTNQQFELIDHEFTEVEKQIGNVINWTRDSMTEVWSYNAELLVAMENQHTIDLADSEMNKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 127 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLMEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 128 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPPVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 129 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKEVILWFSFGASCFILLAIVMGLVFICVKNGNMRCTICI

SEQ ID NO: 130 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 131 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 132 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 133 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDGCMASIRNNTYDHSKYREEAMQNRIQIDPVKLSRGYKDVILWFSFGASCFILLAIVMGLVFICVKNGNMRCTICI

SEQ ID NO: 134 - protein, 560 aa, Influenza A virus
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIGGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 135 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 136 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 137 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLLGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFTLLAIVMGLVFICVKNGNMRCTICI

SEQ ID NO: 138 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVESSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 139 - protein, 560 aa, Influenza A virus
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 140 - protein, 560 aa, Influenza A virus
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVKEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 141 - protein, 560 aa, Influenza A virus
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 142 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 143 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACMRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 144 - protein, 560 aa, Influenza A virus
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 145 - protein, 560 aa, Influenza A virus
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPKYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 146 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 147 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISKLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 148 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 149 - protein, 560 aa, Influenza A virus
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFGLIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 150 - protein, 560 aa, Influenza A virus
  misc_feature (516)..(516): Xaa can be any naturally occurring amino acid
  misc_feature (519)..(519): Xaa can be any naturally occurring amino acid
MNTQILVLALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVXLSXGYKDVILWFSFGASCFILLAIVMGLVFICVKNGNMRCTICI

SEQ ID NO: 151 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFILLAIVMGLVFICVKNGNMRCTICI

SEQ ID NO: 152 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACKRSGSSFYAEMKWLLSNTDNAAFPQMTKSYKNTRKSPALIVWGIHHSVSIAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 153 - protein, 560 aa, Influenza A virus
MNTQILVFALIAIIPTNADKICLGHHAVSNGTKVNTLTERGVEVVNATETVERTNIPRICSKGKKTIDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQVTGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 154 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISDLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 155 - protein, 560 aa, Influenza A virus
MNTQILVFALIAIIPTNADKICLGHHAVSNGTKVNTLTERGVEVVNSTETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRTVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 156 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 157 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPETPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 158 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSNAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 159 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSASTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFGFGASCFILLAIVMGLVFICVKNGNMRCTICI

SEQ ID NO: 160 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 161 - protein, 560 aa, Influenza A virus
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 162 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSASTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 163 - protein, 560 aa, Influenza A virus
  misc_feature (148)..(148): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACXRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 164 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPETPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 165 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFNFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 166 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 167 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYKRVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 168 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYKRVKRQLRENAEEDGTGCFEIFHKCDDDCMASIRNNTYDHNKYREEAMQNRIQIDPVKLSSGYKDVILWFSFGASCFILLAIVMGLVFICVKNGNMRCTICI

SEQ ID NO: 169 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 170 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 171 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 172 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 173 - protein, 560 aa, Influenza A virus
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 174 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGSTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAVVMGLVFICVKNGNMRCTICI

SEQ ID NO: 175 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNATFPQMTKSYKNTRKSPALIIWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 176 - protein, 560 aa, Influenza A virus
MNTQILVFALIAIIPTNADKICLGHHAVSNGTKVNTLTERGVEVVNATETVERTTIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 177 - protein, 560 aa, Influenza A virus
MNTQILVFALIAIVPTNADKICLGHHAVSNGTKVNTLTERGVEVVNATEIVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 178 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSTCRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRACFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVERQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 179 - protein, 560 aa, Influenza A virus
  misc_feature (55)..(55): Xaa can be any naturally occurring amino acid
  misc_feature (129)..(129): Xaa can be any naturally occurring amino acid
  misc_feature (294)..(294): Xaa can be any naturally occurring amino acid
MNTQILVFALIAIIPTNADKICLGHHAVSNGTKVNTLTERGVEVVNATETVERTXIPRICSKGKKTVDLGQCGLLGTITGPPQCDQFLEFSADLIIERREGSDVCYPGKFVNEEALRQILRESGGIDKXAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSXGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 180 - protein, 560 aa, Influenza A virus
  misc_feature (294)..(294): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSXGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 181 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHTVSTAEQTKLYGSGNKLVTVGSSNYQQSFVPSPGARPQVNGLSGRIDLHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 182 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 183 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 184 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 185 - protein, 560 aa, Influenza A virus
  misc_feature (264)..(264): Xaa can be any naturally occurring amino acid
  misc_feature (274)..(274): Xaa can be any naturally occurring amino acid
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPXRASFLRGKSXGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 186 - protein, 560 aa, Influenza A virus
MNTQILVFALIAIIPTNADKICLGHHAVSNGTKVNTLTERGVEVVNATETVERTTIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 187 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 188 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCDGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 189 - protein, 560 aa, Influenza A virus
MNTQILVFALIAIIPANADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGNCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 190 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELMDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 191 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 192 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVRLSSGYKDVILWFSFGASCFILLAIVMGLVFICVKNGNMRCTICI

SEQ ID NO: 193 - protein, 560 aa, Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFMCVKNGNMRCTICI

SEQ ID NO: 194 - protein, 560 aa, Influenza A virus
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEVPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 195 - protein, 560 aa, Influenza A virus
MNTQILVFALISIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGVTSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEVPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 196 - protein, 560 aa, Influenza A virus
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELVDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 197 - protein, 349 aa, Influenza A virus; identical to SEQ ID NO: 1

SEQ ID NO: 198 - protein, 560 aa, Influenza A virus; identical to SEQ ID NO: 2

SEQ ID NO: 199 - protein, 560 aa, Influenza A virus; identical to SEQ ID NO: 3

SEQ ID NO: 200 - protein, 560 aa, Influenza A virus; identical to SEQ ID NO: 4

SEQ ID NO: 201 - protein, 560 aa, Influenza A virus; identical to SEQ ID NO: 5

SEQ ID NO: 202 - protein, 560 aa, Influenza A virus; identical to SEQ ID NO: 6

SEQ ID NO: 203 - protein, 560 aa, Influenza A virus; identical to SEQ ID NO: 7

SEQ ID NO: 204 - protein, 560 aa, Influenza A virus; identical to SEQ ID NO: 8

SEQ ID NO: 205 - protein, 404 aa, Influenza A virus; identical to SEQ ID NO: 9

SEQ ID NO: 206 - protein, 160 aa, Influenza A virus; identical to SEQ ID NO: 10

SEQ ID NO: 207 - protein, 560 aa, Influenza A virus; identical to SEQ ID NO: 11

SEQ ID NO: 208 - protein, 560 aa, Influenza A virus; identical to SEQ ID NO: 12
  misc_feature (47)..(47): Xaa can be any naturally occurring amino acid

SEQ ID NO: 209 - protein, 560 aa, Influenza A virus; identical to SEQ ID NO: 13
  misc_feature (143)..(143): Xaa can be any naturally occurring amino acid

SEQ ID NO: 210 - protein, 303 aa, Influenza A virus; identical to SEQ ID NO: 14

SEQ ID NO: 211 - protein, 556 aa, Influenza A virus; identical to SEQ ID NO: 15

SEQ ID NO: 212 - protein, 556 aa, Influenza A virus; identical to SEQ ID NO: 16

SEQ ID NO: 213 - protein, 555 aa, Influenza A virus; identical to SEQ ID NO: 17

SEQ ID NO: 214 - protein, 555 aa, Influenza A virus; identical to SEQ ID NO: 18

SEQ ID NO: 215 - protein, 557 aa, Influenza A virus; identical to SEQ ID NO: 19

SEQ ID NO: 216 - protein, 560 aa, Influenza A virus; identical to SEQ ID NO: 20

SEQ ID NO: 217 - protein, 560 aa, Influenza A virus; identical to SEQ ID NO: 21

SEQ ID NO: 218 - protein, 560 aa, Influenza A virus; identical to SEQ ID NO: 22

SEQ ID NO: 219 - protein, 560 aa, Influenza A virus; identical to SEQ ID NO: 23

SEQ ID NO: 220 - protein, 560 aa, Influenza A virus; identical to SEQ ID NO: 24

SEQ ID NO: 221 - protein, 560 aa, Influenza A virus; identical to SEQ ID NO: 25

SEQ ID NO: 222 - protein, 560 aa, Influenza A virus; identical to SEQ ID NO: 26

SEQ ID NO: 223 - protein, 560 aa, Influenza A virus; identical to SEQ ID NO: 27

SEQ ID NO: 224 - protein, 560 aa, Influenza A virus; identical to SEQ ID NO: 28

SEQ ID NO: 225 - protein, 560 aa, Influenza A virus; identical to SEQ ID NO: 29

SEQ ID NO: 226 - protein, 560 aa, Influenza A virus; identical to SEQ ID NO: 30

SEQ ID NO: 227 - protein, 206 aa, Influenza A virus; identical to SEQ ID NO: 31

SEQ ID NO: 228 - protein, 206 aa, Influenza A virus; identical to SEQ ID NO: 32

SEQ ID NO: 229 - protein, 549 aa, Influenza A virus; identical to SEQ ID NO: 33

SEQ ID NO: 230 - protein, 552 aa, Influenza A virus; identical to SEQ ID NO: 34

SEQ ID NO: 231 - protein, 196 aa, Influenza A virus; identical to SEQ ID NO: 35

SEQ ID NO: 232 - protein, 193 aa, Influenza A virus; identical to SEQ ID NO: 36

SEQ ID NO: 233 - protein, 192 aa, Influenza A virus; identical to SEQ ID NO: 37

SEQ ID NO: 234 - protein, 191 aa, Influenza A virus; identical to SEQ ID NO: 38

SEQ ID NO: 235 - protein, 193 aa, Influenza A virus; identical to SEQ ID NO: 39

SEQ ID NO: 236 - protein, 560 aa, Influenza A virus; identical to SEQ ID NO: 40

SEQ ID NO: 237 - protein, 560 aa, Influenza A virus; identical to SEQ ID NO: 41

SEQ ID NO: 238 - protein, 559 aa, Influenza A virus; identical to SEQ ID NO: 42
  misc_feature (503)..(503): Xaa can be any naturally occurring amino acid
  misc_feature (507)..(507): Xaa can be any naturally occurring amino acid
  misc_feature (509)..(509): Xaa can be any naturally occurring amino acid
  misc_feature (525)..(525): Xaa can be any naturally occurring amino acid

SEQ ID NO: 239 - protein, 560 aa, Influenza A virus; identical to SEQ ID NO: 43

SEQ ID NO: 240 - protein, 560 aa, Influenza A virus; identical to SEQ ID NO: 44

SEQ ID NO: 241 - protein, 560 aa, Influenza A virus; identical to SEQ ID NO: 45

SEQ ID NO: 242 - protein, 560 aa, Influenza A virus; identical to SEQ ID NO: 46
  misc_feature (215)..(215): Xaa can be any naturally occurring amino acid

SEQ ID NO: 243 - protein, 560 aa, Influenza A virus; identical to SEQ ID NO: 47

SEQ ID NO: 244 - protein, 560 aa, Influenza A virus; identical to SEQ ID NO: 48
  misc_feature (510)..(521): Xaa can be any naturally occurring amino acid

SEQ ID NO: 245 - protein, 560 aa, Influenza A virus; identical to SEQ ID NO: 49

SEQ ID NO: 246 - protein, 560 aa, Influenza A virus; identical to SEQ ID NO: 50

SEQ ID NO: 247 - protein, 560 aa, Influenza A virus; identical to SEQ ID NO: 51

SEQ ID NO: 248 - protein, 560 aa, Influenza A virus; identical to SEQ ID NO: 52

SEQ ID NO: 249 - protein, 560 aa, Influenza A virus; identical to SEQ ID NO: 53

SEQ ID NO: 250 - protein, 560 aa, Influenza A virus; identical to SEQ ID NO: 54

SEQ ID NO: 251 - protein, 560 aa, Influenza A virus; identical to SEQ ID NO: 55

SEQ ID NO: 252 - protein, 560 aa, Influenza A virus; identical to SEQ ID NO: 56

SEQ ID NO: 253 - protein, 560 aa, Influenza A virus; identical to SEQ ID NO: 57

SEQ ID NO: 254 - protein, 553 aa, Influenza A virus; identical to SEQ ID NO: 58
  misc_feature (72)..(72): Xaa can be any naturally occurring amino acid
  misc_feature (137)..(137): Xaa can be any naturally occurring amino acid

SEQ ID NO: 255 - protein, 560 aa, Influenza A virus; identical to SEQ ID NO: 59

SEQ ID NO: 256 - protein, 560 aa, Influenza A virus; identical to SEQ ID NO: 60

SEQ ID NO: 257 - protein, 560 aa, Influenza A virus; identical to SEQ ID NO: 61

SEQ ID NO: 258 - protein, 560 aa, Influenza A virus; identical to SEQ ID NO: 62

SEQ ID NO: 259 - protein, 560 aa, Influenza A virus; identical to SEQ ID NO: 63

SEQ ID NO: 260 - protein, 557 aa, Influenza A virus; identical to SEQ ID NO: 64

SEQ ID NO: 261 - protein, 560 aa, Influenza A virus; identical to SEQ ID NO: 65

SEQ ID NO: 262 - protein, 557 aa, Influenza A virus; identical to SEQ ID NO: 66

SEQ ID NO: 263 - protein, 558 aa, Influenza A virus; identical to SEQ ID NO: 67

SEQ ID NO: 264 - protein, 560 aa, Influenza A virus; identical to SEQ ID NO: 68

SEQ ID NO: 265 - protein, 552 aa, Influenza A virus; identical to SEQ ID NO: 69

SEQ ID NO: 266 - protein, 560 aa, Influenza A virus; identical to SEQ ID NO: 70

SEQ ID NO: 267 - protein, 510 aa, Influenza A virus; identical to SEQ ID NO: 71

SEQ ID NO: 268 - protein, 560 aa, Influenza A virus; identical to SEQ ID NO: 72

SEQ ID NO: 269 - protein, 560 aa, Influenza A virus; identical to SEQ ID NO: 73

SEQ ID NO: 270 - protein, 560 aa, Influenza A virus; identical to SEQ ID NO: 74

SEQ ID NO: 271 - protein, 560 aa, Influenza A virus; identical to SEQ ID NO: 75

SEQ ID NO: 272 - protein, 560 aa, Influenza A virus; identical to SEQ ID NO: 76

SEQ ID NO: 273 - protein, 560 aa, Influenza A virus; identical to SEQ ID NO: 77

SEQ ID NO: 274 - protein, 560 aa, Influenza A virus; identical to SEQ ID NO: 78

SEQ ID NO: 275 - protein, 552 aa, Influenza A virus; identical to SEQ ID NO: 79

SEQ ID NO: 276 - protein, 550 aa, Influenza A virus; identical to SEQ ID NO: 80

SEQ ID NO: 277 - protein, 560 aa, Influenza A virus; identical to SEQ ID NO: 81

SEQ ID NO: 278 - protein, 552 aa, Influenza A virus; identical to SEQ ID NO: 82

SEQ ID NO: 279 - skipped

SEQ ID NO: 280 - protein, 560 aa, Influenza A virus; identical to SEQ ID NO: 83

SEQ ID NO: 281 - protein, 560 aa, Influenza A virus; identical to SEQ ID NO: 84

SEQ ID NO: 282 - protein, 560 aa, Influenza A virus; identical to SEQ ID NO: 85

SEQ ID NO: 283 - protein, 549 aa, Influenza A virus; identical to SEQ ID NO: 86

SEQ ID NO: 284 - protein, 560 aa, Influenza A virus; identical to SEQ ID NO: 87

SEQ ID NO: 285 - protein, 560 aa, Influenza A virus; identical to SEQ ID NO: 88

SEQ ID NO: 286 - protein, 554 aa, Influenza A virus; identical to SEQ ID NO: 89

SEQ ID NO: 287 - protein, 560 aa, Influenza A virus; identical to SEQ ID NO: 90

SEQ ID NO: 288 - protein, 560 aa, Influenza A virus; identical to SEQ ID NO: 91

SEQ ID NO: 289 - protein, 560 aa, Influenza A virus; identical to SEQ ID NO: 92

SEQ ID NO: 290 - protein, 560 aa, Influenza A virus; identical to SEQ ID NO: 93

SEQ ID NO: 291 - protein, 560 aa, Influenza A virus; identical to SEQ ID NO: 94

SEQ ID NO: 292 - protein, 560 aa, Influenza A virus; identical to SEQ ID NO: 95

SEQ ID NO: 293 - protein, 560 aa, Influenza A virus; identical to SEQ ID NO: 96

SEQ ID NO: 294 - protein, 560 aa, Influenza A virus; identical to SEQ ID NO: 97

SEQ ID NO: 295 - protein, 560 aa, Influenza A virus; identical to SEQ ID NO: 98

SEQ ID NO: 296 - protein, 560 aa, Influenza A virus; identical to SEQ ID NO: 99

SEQ ID NO: 297 - protein, 560 aa, Influenza A virus; identical to SEQ ID NO: 100

SEQ ID NO: 298 - protein, 560 aa, Influenza A virus; identical to SEQ ID NO: 101

SEQ ID NO: 299 - protein, 560 aa, Influenza A virus; identical to SEQ ID NO: 102

SEQ ID NO: 300 - protein, 561 aa, Influenza A virus; identical to SEQ ID NO: 103

SEQ ID NO: 301 - protein, 560 aa, Influenza A virus; identical to SEQ ID NO: 104

SEQ ID NO: 302 - protein, 560 aa, Influenza A virus; identical to SEQ ID NO: 105

SEQ ID NO: 303 - protein, 560 aa, Influenza A virus; identical to SEQ ID NO: 106

SEQ ID NO: 304 - protein, 560 aa, Influenza A virus; identical to SEQ ID NO: 107

SEQ ID NO: 305 - protein, 560 aa, Influenza A virus; identical to SEQ ID NO: 108

SEQ ID NO: 306 - protein, 560 aa, Influenza A virus; identical to SEQ ID NO: 109

SEQ ID NO: 307 - protein, 560 aa, Influenza A virus; identical to SEQ ID NO: 110

SEQ ID NO: 308 - protein, 560 aa, Influenza A virus; identical to SEQ ID NO: 111

SEQ ID NO: 309 - protein, 560 aa, Influenza A virus; identical to SEQ ID NO: 112

SEQ ID NO: 310 - protein, 560 aa, Influenza A virus; identical to SEQ ID NO: 113

SEQ ID NO: 311 - protein, 560 aa, Influenza A virus; identical to SEQ ID NO: 114

SEQ ID NO: 312 - protein, 560 aa, Influenza A virus; identical to SEQ ID NO: 115

SEQ ID NO: 313 - protein, 560 aa, Influenza A virus; identical to SEQ ID NO: 116
  misc_feature (183)..(183): Xaa can be any naturally occurring amino acid

SEQ ID NO: 314 - protein, 560 aa, Influenza A virus; identical to SEQ ID NO: 117

SEQ ID NO: 315 - protein, 560 aa, Influenza A virus; identical to SEQ ID NO: 118

SEQ ID NO: 316 - protein, 560 aa, Influenza A virus; identical to SEQ ID NO: 119

SEQ ID NO: 317 - protein, 560 aa, Influenza A virus; identical to SEQ ID NO: 120

SEQ ID NO: 318 - protein, 560 aa, Influenza A virus; identical to SEQ ID NO: 121

SEQ ID NO: 319 - protein, 560 aa, Influenza A virus; identical to SEQ ID NO: 122

SEQ ID NO: 320 - protein, 560 aa, Influenza A virus; identical to SEQ ID NO: 123

SEQ ID NO: 321 - protein, 560 aa, Influenza A virus; identical to SEQ ID NO: 124

SEQ ID NO: 322 - protein, 560 aa, Influenza A virus; identical to SEQ ID NO: 125

SEQ ID NO: 323 - protein, 560 aa, Influenza A virus; identical to SEQ ID NO: 126

SEQ ID NO: 324 - protein, 560 aa, Influenza A virus; identical to SEQ ID NO: 127

SEQ ID NO: 325 - protein, 560 aa, Influenza A virus; identical to SEQ ID NO: 128

SEQ ID NO: 326 - protein, 560 aa, Influenza A virus; identical to SEQ ID NO: 129

SEQ ID NO: 327 - protein, 560 aa, Influenza A virus; identical to SEQ ID NO: 130

SEQ ID NO: 328 - protein, 560 aa, Influenza A virus; identical to SEQ ID NO: 131

SEQ ID NO: 329 - protein, 560 aa, Influenza A virus; identical to SEQ ID NO: 132

SEQ ID NO: 330 - protein, 560 aa, Influenza A virus; identical to SEQ ID NO: 133

SEQ ID NO: 331 - protein, 560 aa, Influenza A virus; identical to SEQ ID NO: 134

SEQ ID NO: 332 - protein, 560 aa, Influenza A virus; identical to SEQ ID NO: 135

SEQ ID NO: 333 - protein, 560 aa, Influenza A virus; identical to SEQ ID NO: 136

SEQ ID NO: 334 - protein, 560 aa, Influenza A virus; identical to SEQ ID NO: 137

SEQ ID NO: 335 - protein, 560 aa, Influenza A virus; identical to SEQ ID NO: 138

SEQ ID NO: 336 - protein, 560 aa, Influenza A virus; identical to SEQ ID NO: 139

SEQ ID NO: 337 - protein, 560 aa, Influenza A virus; identical to SEQ ID NO: 140

SEQ ID NO: 338 - protein, 560 aa, Influenza A virus; identical to SEQ ID NO: 141

SEQ ID NO: 339 - protein, 560 aa, Influenza A virus; identical to SEQ ID NO: 142

SEQ ID NO: 340 - protein, 560 aa, Influenza A virus; identical to SEQ ID NO: 143

SEQ ID NO: 341 - protein, 560 aa, Influenza A virus; identical to SEQ ID NO: 144

SEQ ID NO: 342 - protein, 560 aa, Influenza A virus; identical to SEQ ID NO: 145

SEQ ID NO: 343 - protein, 560 aa, Influenza A virus; identical to SEQ ID NO: 146

SEQ ID NO: 344 - protein, 560 aa, Influenza A virus; identical to SEQ ID NO: 147

SEQ ID NO: 345 - protein, 560 aa, Influenza A virus; identical to SEQ ID NO: 148

SEQ ID NO: 346 - protein, 560 aa, Influenza A virus; identical to SEQ ID NO: 149

SEQ ID NO: 347 - protein, 560 aa, Influenza A virus; identical to SEQ ID NO: 150
  misc_feature (516)..(516): Xaa can be any naturally occurring amino acid
  misc_feature (519)..(519): Xaa can be any naturally occurring amino acid

SEQ ID NO: 348 - protein, 560 aa, Influenza A virus; identical to SEQ ID NO: 151

SEQ ID NO: 349 - protein, 560 aa, Influenza A virus; identical to SEQ ID NO: 152

SEQ ID NO: 350 - protein, 560 aa, Influenza A virus; identical to SEQ ID NO: 153

SEQ ID NO: 351 - protein, 560 aa, Influenza A virus; identical to SEQ ID NO: 154

SEQ ID NO: 352 - protein, 560 aa, Influenza A virus; identical to SEQ ID NO: 155

SEQ ID NO: 353 - protein, 560 aa, Influenza A virus; identical to SEQ ID NO: 156

SEQ ID NO: 354 - protein, 560 aa, Influenza A virus; identical to SEQ ID NO: 157

SEQ ID NO: 355 - protein, 560 aa, Influenza A virus; identical to SEQ ID NO: 158

SEQ ID NO: 356 - protein, 560 aa, Influenza A virus; identical to SEQ ID NO: 159

SEQ ID NO: 357 - protein, 560 aa, Influenza A virus; identical to SEQ ID NO: 160

SEQ ID NO: 358 - protein, 560 aa, Influenza A virus; identical to SEQ ID NO: 161

SEQ ID NO: 359 - protein, 560 aa, Influenza A virus; identical to SEQ ID NO: 162

SEQ ID NO: 360 - protein, 560 aa, Influenza A virus; identical to SEQ ID NO: 163
  misc_feature (148)..(148): Xaa can be any naturally occurring amino acid

SEQ ID NO: 361 - protein, 560 aa, Influenza A virus; identical to SEQ ID NO: 164

SEQ ID NO: 362 - protein, 560 aa, Influenza A virus; identical to SEQ ID NO: 165

SEQ ID NO: 363 - protein, 560 aa, Influenza A virus; identical to SEQ ID NO: 166

SEQ ID NO: 364 - protein, 560 aa, Influenza A virus; identical to SEQ ID NO: 167

SEQ ID NO: 365 - protein, 560 aa, Influenza A virus; identical to SEQ ID NO: 168

SEQ ID NO: 366 - protein, 560 aa, Influenza A virus; identical to SEQ ID NO: 169

SEQ ID NO: 367 - protein, 560 aa, Influenza A virus; identical to SEQ ID NO: 170

SEQ ID NO: 368 - protein, 560 aa, Influenza A virus; identical to SEQ ID NO: 171

SEQ ID NO: 369 - protein, 560 aa, Influenza A virus; identical to SEQ ID NO: 172

SEQ ID NO: 370 - protein, 560 aa, Influenza A virus; identical to SEQ ID NO: 173

SEQ ID NO: 371 - protein, 560 aa, Influenza A virus; identical to SEQ ID NO: 174

SEQ ID NO: 372 - protein, 560 aa, Influenza A virus; identical to SEQ ID NO: 175

SEQ ID NO: 373 - protein, 560 aa, Influenza A virus; identical to SEQ ID NO: 176

SEQ ID NO: 374 - protein, 560 aa, Influenza A virus; identical to SEQ ID NO: 177

SEQ ID NO: 375 - protein, 560 aa, Influenza A virus; identical to SEQ ID NO: 178

SEQ ID NO: 376 - protein, 560 aa, Influenza A virus; identical to SEQ ID NO: 179
  misc_feature (55)..(55): Xaa can be any naturally occurring amino acid
  misc_feature (129)..(129): Xaa can be any naturally occurring amino acid
  misc_feature (294)..(294): Xaa can be any naturally occurring amino acid

SEQ ID NO: 377 - protein, 560 aa, Influenza A virus; identical to SEQ ID NO: 180
  misc_feature (294)..(294): Xaa can be any naturally occurring amino acid

SEQ ID NO: 378 - protein, 560 aa, Influenza A virus; identical to SEQ ID NO: 181

SEQ ID NO: 379 - protein, 560 aa, Influenza A virus; identical to SEQ ID NO: 182

SEQ ID NO: 380 - protein, 560 aa, Influenza A virus; identical to SEQ ID NO: 183

SEQ ID NO: 381 - protein, 560 aa, Influenza A virus; identical to SEQ ID NO: 184

SEQ ID NO: 382 - protein, 560 aa, Influenza A virus; identical to SEQ ID NO: 185
  misc_feature (264)..(264): Xaa can be any naturally occurring amino acid
  misc_feature (274)..(274): Xaa can be any naturally occurring amino acid

SEQ ID NO: 383 - protein, 560 aa, Influenza A virus; identical to SEQ ID NO: 186

SEQ ID NO: 384 - protein, 560 aa, Influenza A virus; identical to SEQ ID NO: 187

SEQ ID NO: 385 - protein, 560 aa, Influenza A virus; identical to SEQ ID NO: 188

SEQ ID NO: 386 - protein, 560 aa, Influenza A virus; identical to SEQ ID NO: 189

SEQ ID NO: 387 - protein, 560 aa, Influenza A virus; identical to SEQ ID NO: 190

SEQ ID NO: 388 - protein, 560 aa, Influenza A virus; identical to SEQ ID NO: 191

SEQ ID NO: 389 - protein, 560 aa, Influenza A virus; identical to SEQ ID NO: 192

SEQ ID NO: 390 - protein, 560 aa, Influenza A virus; identical to SEQ ID NO: 193

SEQ ID NO: 391 - protein, 560 aa, Influenza A virus; identical to SEQ ID NO: 194

SEQ ID NO: 392 - protein, 560 aa, Influenza A virus; identical to SEQ ID NO: 195

SEQ ID NO: 393 - protein, 560 aa, Influenza A virus; identical to SEQ ID NO: 196

SEQ ID NO: 394 - protein, 172 aa, Influenza A virus
DTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTYNAELLVLLENERTLDAHDSQGTGGGYIPEAPRDGQAYVRKDGEWVLLSTFL

SEQ ID NO: 395 - protein, 172 aa, Influenza A virus
DTVDTVLEKNVTVTHSVNLLEDKHGSANTSLPFQNTHPTTNGKCPKYVKSTKLRLATGLRNGSAGSATQNAIDEITNKVNSVIEKMNTQDTATGKEFNHDEKRIENLNKKVDDGFLDIWTYNAELLVLLENERTLDAHDSQGTGGGYIPEAPRDGQAYVRKDGEWVLLSTFL

SEQ ID NO: 396 - protein, 172 aa, Influenza A virus
DTVDTVLEKNVTVTHSVNLLEDSHGSANSSLPFQNTHPTTNGESPKYVRSAKLRMVTGLRNGSAGSATQNAINGITNKVNSVIEKMNTQDTAVGKEFNKDERRMENLNKKVDDGFLDIWTYNAELLVLLENERTLDAHDSQGTGGGYIPEAPRDGQAYVRKDGEWVLLSTFL

SEQ ID NO: 397 - protein, 172 aa, Influenza A virus
DTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTYNAELLVLLENERTLDAHDSQGTGGGYIPEAPRDGQAYVRKDGEWVLLSTFL

SEQ ID NO: 398 - protein, 172 aa, Influenza A virus
HAVPNGTIVKTITNDQIEVTNATEGSAPNDKPFQNTNRTTTGACPRYVKQNTLKLATGMRNGSAGSATQAAINQINGKLNRLIGKTNEKDHQDEKEFSEDEGRIQDLEKYVEDTKIDLWSYNAELLVALENQHTIDATDSQGTGGGYIPEAPRDGQAYVRKDGEWVLLSTFL

SEQ ID NO: 399 - protein, 172 aa, Influenza A virus
EQVDTIMEKNVTVTHAQDILEKTHGSANSSMPFHNTHPNTTGESPKYVKSNRLVLATGLRNGSAGSATQKAIDGVTNKVNSIIDKMNTQFEADGREFNNDERRIENLNKKMEDGFLDVWTYNAELLVLMENERTLDAHDSQGTGGGYIPEAPRDGQAYVRKDGEWVLLSTFL

SEQ ID NO: 400 - protein, 171 aa, Influenza A virus
TKVNTLTERGVEVVNATETVERTGSAISNLPFQNTDSTANGKCPRYVKQRSLLLATGMKNGSAGSATQSAIDQITGKLNRLIEKTNQQDELTDNEFNEDEKQIGNVINWTRDSITEVWSYNAELLVAMENQHTIDAADSQGTGGGYIPEAPRDGQAYVRKDGEWVLLSTFL

SEQ ID NO: 401 - protein, 172 aa, Influenza A virus
ETVDTLTETNVPVTHAKELLHTEHGSANSTLPFHNTSKTANGTCPKYVRVNSLKLAVGLRNGSAGSATQKAIDKITSKVNNIVDKMNKQDEITDHEFSEDETRLNMINNKIDDQIQDVWAYNAELLVLLENQKTLDAHDSQGTGGGYIPEAPRDGQAYVRKDGEWVLLSTFL

SEQ ID NO: 402 - protein, 171 aa, Influenza A virus
TIVKTLTNEQEEVTNATETVESTGGSANTRLPFQNTSPTTNGQCPKYVNRRSLMLATGMRNGSAGSATQAAIDQITGKLNRLVEKTNTEDSITSEFSEIEHQIGNVINWTKDSITDIWTYQAELLVAMENQHTIDAADSQGTGGGYIPEAPRDGQAYVRKDGEWVLLSTFL

SEQ ID NO: 403 - protein, 192 aa, Influenza A virus
METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTYNAELLVLLENERTLDAHDSQGTGGGYIPEAPRDGQAYVRKDGEWVLLSTFL

SEQ ID NO: 404 - protein, 192 aa, Influenza A virus
METPAQLLFLLLLWLPDTTGDTVDTVLEKNVTVTHSVNLLEDKHGSANTSLPFQNTHPTTNGKCPKYVKSTKLRLATGLRNGSAGSATQNAIDEITNKVNSVIEKMNTQDTATGKEFNHDEKRIENLNKKVDDGFLDIWTYNAELLVLLENERTLDAHDSQGTGGGYIPEAPRDGQAYVRKDGEWVLLSTFL

SEQ ID NO: 405 - protein, 192 aa, Influenza A virus
METPAQLLFLLLLWLPDTTGDTVDTVLEKNVTVTHSVNLLEDSHGSANSSLPFQNTHPTTNGESPKYVRSAKLRMVTGLRNGSAGSATQNAINGITNKVNSVIEKMNTQDTAVGKEFNKDERRMENLNKKVDDGFLDIWTYNAELLVLLENERTLDAHDSQGTGGGYIPEAPRDGQAYVRKDGEWVLLSTFL

SEQ ID NO: 406 - protein, 192 aa, Influenza A virus
METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTYNAELLVLLENERTLDAHDSQGTGGGYIPEAPRDGQAYVRKDGEWVLLSTFL

SEQ ID NO: 407 - protein, 192 aa, Influenza A virus
METPAQLLFLLLLWLPDTTGHAVPNGTIVKTITNDQIEVTNATEGSAPNDKPFQNTNRTTTGACPRYVKQNTLKLATGMRNGSAGSATQAAINQINGKLNRLIGKTNEKDHQDEKEFSEDEGRIQDLEKYVEDTKIDLWSYNAELLVALENQHTIDATDSQGTGGGYIPEAPRDGQAYVRKDGEWVLLSTFL

SEQ ID NO: 408 - protein, 192 aa, Influenza A virus
METPAQLLFLLLLWLPDTTGEQVDTIMEKNVTVTHAQDILEKTHGSANSSMPFHNTHPNTTGESPKYVKSNRLVLATGLRNGSAGSATQKAIDGVTNKVNSIIDKMNTQFEADGREFNNDERRIENLNKKMEDGFLDVWTYNAELLVLMENERTLDAHDSQGTGGGYIPEAPRDGQAYVRKDGEWVLLSTFL

SEQ ID NO: 409 - protein, 191 aa, Influenza A virus
METPAQLLFLLLLWLPDTTGTKVNTLTERGVEVVNATETVERTGSAISNLPFQNTDSTANGKCPRYVKQRSLLLATGMKNGSAGSATQSAIDQITGKLNRLIEKTNQQDELTDNEFNEDEKQIGNVINWTRDSITEVWSYNAELLVAMENQHTIDAADSQGTGGGYIPEAPRDGQAYVRKDGEWVLLSTFL

SEQ ID NO: 410 - protein, 192 aa, Influenza A virus
METPAQLLFLLLLWLPDTTGETVDTLTETNVPVTHAKELLHTEHGSANSTLPFHNTSKTANGTCPKYVRVNSLKLAVGLRNGSAGSATQKAIDKITSKVNNIVDKMNKQDEITDHEFSEDETRLNMINNKIDDQIQDVWAYNAELLVLLENQKTLDAHDSQGTGGGYIPEAPRDGQAYVRKDGEWVLLSTFL

SEQ ID NO: 411 - protein, 191 aa, Influenza A virus
METPAQLLFLLLLWLPDTTGTIVKTLTNEQEEVTNATETVESTGGSANTRLPFQNTSPTTNGQCPKYVNRRSLMLATGMRNGSAGSATQAAIDQITGKLNRLVEKTNTEDSITSEFSEIEHQIGNVINWTKDSITDIWTYQAELLVAMENQHTIDAADSQGTGGGYIPEAPRDGQAYVRKDGEWVLLSTFL

SEQ ID NO: 412 - protein, 194 aa, Influenza A virus
METPAQLLFLLLLWLPDTTGASPNGTLVKTITDDQIEVTNATELVQSSGSAGSANDKPFQNTNKRTSGASPKYVKQNTLKLATGQRGSAGSAATDQINGKLNRVIEKTNEKDHQIEKEFSEDEGRIQDLEKYVEDTKIDLWSYNAELLVALENQHTIDLTDSQGTGGGYIPEAPRDGQAYVRKDGEWVLLSTFL

SEQ ID NO: 413 - protein, 277 aa, Influenza A virus
METPAQLLFLLLLWLPDTTGGLFGAIAGFIENGWEGMIDGWYGFRHQNSEGTGQAADLKSTQAAIDQINGKLNRVIEKTNEKDHQIEKEFSEDEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQGSAGSAGDNSTATLCLGHHAVPNGTLVKTITDDQIEVTNATELVQSSGSAGSANDKPFQNTNKETTGATPKYVKQNTLKLATGMR

SEQ ID NO: 414 - protein, 278 aa, Influenza A virus
METPAQLLFLLLLWLPDTTGGLFGAIAGFIEGGWTGMIDGWYGYHHQNEQGSGYAADQKSTQNAINGITNKVNTVIEKMNIQDTATGKEFNKDEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKGSAGSAAADADTICIGYHANNSTDTVDTVLEKNVTVTHSVNLLEDSHGSANSSLPYQNTHPTTNGESPKYVRSAKLRMVTGLRNIP

SEQ ID NO: 415 - protein, 192 aa, Influenza A virus
METPAQLLFLLLLWLPDTTGDTVDTVLEKNVTVTHSVNLLEDSHGSANSSLPYQNTHPTTNGESPKYVRSAKLRMVTGLRNGGAGSATQNAINGITNKVNTVIEKMNIQDTATGKEFNKDEKRMENLNKKVDDGFLDIWTYNAELLVLLENERTLDAHDSQGTGGGYIPEAPRDGQAYVRKDGEWVLLSTFL

SEQ ID NO: 416 - protein, 562 aa, Influenza A virus
METPAQLLFLLLLWLPDTTGDTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPNLKNSYVNKKGKEVLVLWGIHHPSNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 417 - protein, 559 aa, Influenza A virus
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPNLKNSYVNKKGKEVLVLWGIHHPSNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 418 - protein, 202 aa, Influenza A virus
METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTYNAELLVLLENERTLDAHDSQGTGGILAIYSTVASSLVLLVSLGAISFWMCSNGSLQCRICI

SEQ ID NO: 419 - protein, 160 aa, Influenza A virus
METPAQLLFLLLLWLPDTTGDTVDTVCEKNVTVTHSVNLLEDSHGSANSSLPYQNTHPTTNGESPKYVRSAKLRMVTGLRNGSAGSATQNAINCITNKVNTVIEKMNIQDTATGKEFNKDEKRMENLNKKVDDGFLDIWTYNAELLVLLENERTLDAHDS

SEQ ID NO: 420 - protein, 160 aa, Influenza A virus
METPAQLLFLLLLWLPDTTGDTVDTVCEKNVTVTHSVNLLEDKHGSANTSLPFQNTHPTTNGKSPKYVKSTKLRLATGLRNGSAGSATQNAIDCITNKVNSVIEKMNTQDTAVGKEFNHDEKRIENLNKKVDDGFLDIWTYNAELLVLLENERTLDAHDS

SEQ ID NO: 421 - protein, 498 aa, Influenza A virus
MASQGTKRSYEQMETDGERQNATEIRASVGKMIDGIGRFYIQMCTELKLSDYEGRLIQNSLTIERMVLSAFDERRNRYLEEHPSAGKDPKKTGGPIYKRVDGRWMRELVLYDKEEIRRIWRQANNGDDATAGLTHMMIWHSNLNDTTYQRTRALVRTGMDPRMCSLMQGSTLPRRSGAAGAAVKGIGTMVMELIRMIKRGINDRNFWRGENGRKTRSAYERMCNILKGKFQTAAQRAMMDQVRESRNPGNAEIEDLIFSARSALILRGSVAHKSCLPACVYGPAVSSGYNFEKEGYSLVGIDPFKLLQNSQVYSLIRPNENPAHKSQLVWMACHSAAFEDLRLLSFIRGTKVSPRGKLSTRGVQIASNENMDNMESSTLELRSRYWAIRTRSGGNTNQQRASAGQISVQPTFSVQRNLPFEKSTVMAAFTGNTEGRTSDMRAEIIRMMEGAKPEEVSFRGRGVFELSDEKATNPIVPSFDMSNEGSYFFGDNAEEYDN

SEQ ID NO: 422 - protein, 191 aa, Influenza B virus
METPAQLLFLLLLWLPDTTGHVVKTATQGEVNVTGVIPLTTTPTGSANKSKPYYTGEHAKAIGNCPIWVKTPLKLANGTKYGSAGSATQEAINKITKNLNSLSELEVKNLQRLSGAMDELHNEILELDEKVDDLRADTISSQIELAVLLSNEGIINSEDEGTGGGYIPEAPRDGQAYVRKDGEWVLLSTFL

SEQ ID NO: 423 - protein, 583 aa, Influenza B virus
MKAIIVLLMVVTSNADRICTGITSSNSPHVVKTATQGEVNVTGVIPLTTTPTKSHFANLKGTKTRGKLCPNCLNCTDLDVALGRPMCMGTIPSAKASILHEVRPVTSGCFPIMHDRTKIRQLPNLLRGYENIRLSTHNVINAERAPGGPYRLGTSGSCPNVTSRNGFFATMAWAVPRDNKTATNPLTVEVPYICTKGEDQITVWGFHSDDKTQMKNLYGDSNPQKFTSSANGVTTHYVSQIGDFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 424 - protein, 546 aa, Influenza B virus
MKAIIVLLMVVTSNADRICTGITSSNSPHVVKTATQGEVNVTGVIPLTTTPTKSHFANLKGTKTRGKLCPNCLNCTDLDVALGRPMCMGTIPSAKASILHEVRPVTSGCFPIMHDRTKIRQLPNLLRGYENIRLSTHNVINAERAPGGPYRLGTSGSCPNVTSRNGFFATMAWAVPRDNKTATNPLTVEVPYICTKGEDQITVWGFHSDDKTQMKNLYGDSNPQKFTSSANGVTTHYVSQIGDFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHT

SEQ ID NO: 425 - protein, 585 aa, Influenza B virus
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKASILHEVKPVTSGCFPIMHDRTKIRQLPNLLRGYEHIRLSTHNVINAETAPGGPYKVGTSGSCPNVTNGNGFFATMAWAVPKNDNNKTATNPLTVEVPYICTEGEDQITVWGFHSDNEAQMVKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNKILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 426 - protein, 548 aa, Influenza B virus
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKASILHEVKPVTSGCFPIMHDRTKIRQLPNLLRGYEHIRLSTHNVINAETAPGGPYKVGTSGSCPNVTNGNGFFATMAWAVPKNDNNKTATNPLTVEVPYICTEGEDQITVWGFHSDNEAQMVKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNKILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHT

SEQ ID NO: 427 - protein, 585 aa, Influenza B virus
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 428 - protein, 548 aa, Influenza B virus
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHT

SEQ ID NO: 429 - protein, 584 aa, Influenza B virus
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAASLNDDGLDNHTILLYYSTAASSLAVTLMLAIFIVYMVSRDNVSCSICL

SEQ ID NO: 430 - protein, 547 aa, Influenza B virus
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAASLNDDGLDNHT

SEQ ID NO: 431 - protein, 328 aa, Artificial Sequence
  Synthetic Polypeptide
METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTYNAELLVLLENERTLDAHDSQGTGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 432 - protein, 384 aa, Artificial Sequence
  Synthetic Polypeptide
METPAQLLFLLLLWLPDTTGDTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 433 - protein, 248 aa, Artificial Sequence
  Synthetic Polypeptide
METPAQLLFLLLLWLPDTTGDTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDPGSGYIPEAPRDGQAYVRKDGEWVLLSTFL

SEQ ID NO: 434 - protein, 267 aa, Artificial Sequence
  Synthetic Polypeptide
METPAQLLFLLLLWLPDTTGDTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQ

SEQ ID NO: 435 - protein, 160 aa, Artificial Sequence
  Synthetic Polypeptide
METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGKEFNHDEKRIENLNKKVDDGFLDIWTDLAELLVLLENERTLDAHDS

SEQ ID NO: 436 - protein, 160 aa, Artificial Sequence
  Synthetic Polypeptide
METPAQLLFLLLLWLPDTTGDTVDTVLEKNVTVTHSVNLLEDKHGSANTSLPFQNTHPTTNGKSPKYVKSTKLRLATGLRNGSAGSATQNAIDEITNKVNSVIEKMNTQDTAVGCEFNHDEKCIENLNKKVDDGFLDIWTYNAELLVLLENERTLDAHDS

SEQ ID NO: 437 - protein, 160 aa, Artificial Sequence
  Synthetic Polypeptide
METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGKEFNKDEKRMENLNKKVDDGFLDIWTDLAELLVLLENERTLDAHDS

SEQ ID NO: 438 - protein, 160 aa, Artificial Sequence
  Synthetic Polypeptide
METPAQLLFLLLLWLPDTTGDTVDTVLEKNVTVTHSVNLLEDSHGSANSSLPYQNTHPTTNGESPKYVRSAKLRMVTGLRNGSAGSATQNAINGITNKVNTVIEKMNIQDTATGCEFNKDEKCMENLNKKVDDGFLDIWTYNAELLVLLENERTLDAHDS

SEQ ID NO: 439 - protein, 97 aa, Influenza A virus
MSLLTEVETPIRNEWGCRCNGSSDPLAIAANIIGILHLILWILDRLFFKCIYRRFKYGLKGGPSTEGVPKSMREEYRKEQQSAVDADDGHFVSIELE

SEQ ID NO: 440 - protein, 252 aa, Influenza A virus
MSLLTEVETYVLSIIPSGPLKAEIAQRLESVFAGKNTDLEALMEWLKTRPILSPLTKGILGFVFTLTVPSERGLQRRRFVQNALNGNGDPNNMDRAVKLYKKLKREITFHGAKEVSLSYSTGALASCMGLIYNRMGTVTTEAAFGLVCATCEQIADSQHRSHRQMATTTNPLIRHENRMVLASTTAKAMEQMAGSSEQAAEAMEVANQTRQMVHAMRTIGTHPSSSAGLKDDLLENLQAYQKRMGVQMQRFK

SEQ ID NO: 441 - protein, 191 aa, Influenza B virus
METPAQLLFLLLLWLPDTTGHVVKTATQGEVNVTGVIPLTTTPTGSANKSKPYYTGEHAKATGNCPIWVKTPLKLANGTKYGSAGSATQEAINKITKNLNSLSELEVKNLQRLSGASDETHNEILELDEKVDDLRADTISSQIELAVLLSNEGIINSEDEGTGGGYIPEAPRDGQAYVRKDGEWVLLSTFL

SEQ ID NO: 442 - protein, 171 aa, Influenza B virus
HVVKTATQGEVNVTGVIPLTTTPTGSANKSKPYYTGEHAKATGNCPIWVKTPLKLANGTKYGSAGSATQEAINKITKNLNSLSELEVKNLQRLSGASDETHNEILELDEKVDDLRADTISSQIELAVLLSNEGIINSEDEGTGGGYIPEAPRDGQAYVRKDGEWVLLSTFL

SEQ ID NO: 443 - protein, 160 aa, Influenza B virus
METPAQLLFLLLLWLPDTTGHVVKTATQGEVNVTGVIPLTTTPTGSANKSKPYYTGEHAKATGNCPIWVKTPLKLANGTKYGSAGSATQEAINKITKNLNSLSELEVKNLQRLSCASDETHNCILELDEKVDDLRADTISSLIELAVLLSNEGIINSEDE

SEQ ID NO: 444 - protein, 140 aa, Influenza B virus
HVVKTATQGEVNVTGVIPLTTTPTGSANKSKPYYTGEHAKATGNCPIWVKTPLKLANGTKYGSAGSATQEAINKITKNLNSLSELEVKNLQRLSCASDETHNCILELDEKVDDLRADTISSLIELAVLLSNEGIINSEDE

SEQ ID NO: 445 - DNA, 92 bp, Artificial Sequence
  Synthetic Polynucleotide
tcaagcttttggaccctcgtacagaagctaatacgactcactatagggaaataagagagaaaagaagagtaagaagaaatataagagccacc

SEQ ID NO: 446 - DNA, 119 bp, Artificial Sequence
  Synthetic Polynucleotide
tgataataggctggagcctcggtggccatgcttcttgccccttgggcctccccccagcccctcctccccttcctgcacccgtacccccgtggtctttgaataaagtctgagtgggcggc

SEQ ID NO: 447 - DNA, 1749 bp, Influenza B virus
atgaaggcaataattgtactactcatggtagtaacatccaacgcagatcgaatctgcactgggataacatcttcaaactcacctcatgtggtcaaaacagctactcaaggggaagttaatgtgactggtgtgataccactgacaacaacaccaacaaaatctcattttgcaaatctcaaaggaacaaagaccagagggaaactatgcccaaactgtctcaactgcacagatctggatgtggccttgggcagaccaatgtgtatggggaccataccttcggcaaaagcttcaatactccacgaagtcagacctgttacatccgggtgctttcctataatgcacgacagaacaaaaatcagacagctacccaatcttctcagaggatatgaaaatatcagattatcaacccataacgttatcaacgcagaaagggcaccaggaggaccctacagacttggaacctcaggatcttgccctaacgttaccagtagaaacggattcttcgcaacaatggcttgggctgtcccaagggacaacaaaacagcaacgaatccactaacagtagaagtaccatacatttgcacaaaaggagaagaccaaattactgtttgggggttccattctgatgacaaaacccaaatgaaaaacctctatggagactcaaatcctcaaaagttcacctcatctgccaatggagtaaccacacattatgtttctcagattggtgacttcccaaatcaaacagaagacggagggctaccacaaagcggcagaattgttgttgattacatggtgcaaaaacctgggaaaacaggaacaattgtctatcaaagaggtgttttgttgcctcaaaaggtgtggtgcgcaagtggcaggagcaaggtaataaaagggtccttgcctttaattggtgaagcagattgccttcacgaaaaatacggtggattaaacaaaagcaagccttactacacaggagaacatgcaaaagccataggaaattgcccaatatgggtgaaaacacctttgaagcttgccaatggaaccaaatatagacctcctgcaaaactattaaaggaaaggggtttcttcggagctattgctggtttcttagagggaggatgggaaggaatgattgcaggttggcacggatacacatctcatggagcacatggagtggcagtggcagcagaccttaagagcacgcaagaagccataaacaagataacaaaaaatctcaattctttgagtgagctagaagtaaagaatcttcaaagactaagtggtgccatggatgaactccacaacgaaatactcgagctggatgagaaagtggatgatctcagagctgacacaataagctcgcaaatagagcttgcagtcttgctttccaacgaaggaataataaacagtgaagatgagcatctattggcacttgagagaaaactaaagaaaatgctgggtccctctgctgtagacatagggaatggatgcttcgaaaccaaacacaagtgcaaccagacctgcttagacaggatagctgctggcacctttaatgcaggagaattttctcttcccacttttgattcactgaatattactgctgcatctttaaatgatgatggattggataatcatactatactgctctactactcaactgctgcttctagtttggccgtaacattgatgatagctatttttattgtttatatggtctccagagacaatgtttcttgctccatctgtcta

SEQ ID NO: 448 - DNA, 1638 bp, Influenza B virus
atgaaggcaataattgtactactcatggtagtaacatccaacgcagatcgaatctgcactgggataacatcttcaaactcacctcatgtggtcaaaacagctactcaaggggaagttaatgtgactggtgtgataccactgacaacaacaccaacaaaatctcattttgcaaatctcaaaggaacaaagaccagagggaaactatgcccaaactgtctcaactgcacagatctggatgtggccttgggcagaccaatgtgtatggggaccataccttcggcaaaagcttcaatactccacgaagtcagacctgttacatccgggtgctttcctataatgcacgacagaacaaaaatcagacagctacccaatcttctcagaggatatgaaaatatcagattatcaacccataacgttatcaacgcagaaagggcaccaggaggaccctacagacttggaacctcaggatcttgccctaacgttaccagtagaaacggattcttcgcaacaatggcttgggctgtcccaagggacaacaaaacagcaacgaatccactaacagtagaagtaccatacatttgcacaaaaggagaagaccaaattactgtttgggggttccattctgatgacaaaacccaaatgaaaaacctctatggagactcaaatcctcaaaagttcacctcatctgccaatggagtaaccacacattatgtttctcagattggtgacttcccaaatcaaacagaagacggagggctaccacaaagcggcagaattgttgttgattacatggtgcaaaaacctgggaaaacaggaacaattgtctatcaaagaggtgttttgttgcctcaaaaggtgtggtgcgcaagtggcaggagcaaggtaataaaagggtccttgcctttaattggtgaagcagattgccttcacgaaaaatacggtggattaaacaaaagcaagccttactacacaggagaacatgcaaaagccataggaaattgcccaatatgggtgaaaacacctttgaagcttgccaatggaaccaaatatagacctcctgcaaaactattaaaggaaaggggtttcttcggagctattgctggtttcttagagggaggatgggaaggaatgattgcaggttggcacggatacacatctcatggagcacatggagtggcagtggcagcagaccttaagagcacgcaagaagccataaacaagataacaaaaaatctcaattctttgagtgagctagaagtaaagaatcttcaaagactaagtggtgccatggatgaactccacaacgaaatactcgagctggatgagaaagtggatgatctcagagctgacacaataagctcgcaaatagagcttgcagtcttgctttccaacgaaggaataataaacagtgaagatgagcatctattggcacttgagagaaaactaaagaaaatgctgggtccctctgctgtagacatagggaatggatgcttcgaaaccaaacacaagtgcaaccagacctgcttagacaggatagctgctggcacctttaatgcaggagaattttctcttcccacttttgattcactgaatattactgctgcatctttaaatgatgatggattggataatcatact

SEQ ID NO: 449 - DNA, 1755 bp, Influenza B virus
atgaaggcaataattgtactactcatggtagtaacatccaatgcagatcgaatctgcactgggataacatcgtcaaactcaccccatgtggtcaaaactgctactcaaggggaagtcaatgtgactggtgtgataccactgacaacaacacccaccaaatctcattttgcaaatctcaaaggaacaaaaaccagagggaaactatgcccaaagtgtctcaactgcacagatctggacgtggccttgggcagaccaaagtgcacggggaccataccttcggcaaaagcttcaatactccacgaagtcaaacctgttacatctgggtgctttcctataatgcacgacagaacaaaaattagacagctacccaatcttctcagaggatacgaacatatcaggttatcaacccataacgttatcaacgcagaaacggcaccaggaggaccctacaaagttggaacctcagggtcttgccctaacgttaccaatggaaacggattcttcgcaacaatggcttgggctgtcccaaaaaacgacaacaacaaaacagcaacaaatccattaacagtagaagtaccatacatttgtacagaaggagaagaccaaattactgtttgggggttccactctgataacgaagcccaaatggtaaaactctatggagactcaaagcctcagaagttcacctcatctgccaacggagtgaccacacattacgtttcacagattggtggcttcccaaatcaagcagaagacggagggctaccacaaagcggtagaattgttgttgattacatggtgcaaaaatctggaaaaacaggaacaattacctaccaaagaggtattttattgcctcaaaaagtgtggtgcgcaagtggcaggagcaaggtaataaaagggtccttgcctttaattggcgaagcagattgcctccacgaaaaatacggtggattaaacaaaagcaagccttactacacaggggaacatgcaaaagccataggaaattgcccaatatgggtgaaaacacccttgaagctggccaatggaaccaaatatagacctcctgcaaaactattaaaggaaaagggtttcttcggagctattgctggtttcttagaaggaggatgggaaggaatgattgcaggttggcacggatacacatcccatggagcacatggagtagcagtggcagcagaccttaagagtacgcaagaagccataaacaagataacaaaaaatctcaattctttgagtgagctggaagtaaagaatcttcaaagactaagcggtgccatggatgaactccacaacaaaatactcgaactggatgagaaagtggatgatctcagagctgatacaataagctcgcaaatagagctcgcagtcttgctttccaacgaaggaataataaacagtgaagatgagcatctcttggcgcttgaaagaaaactgaagaaaatgctgggcccctctgctgtagagatagggaatggatgcttcgaaaccaaacacaagtgcaaccagacctgcctcgacagaatagctgctggcacctttaatgcaggagaattttctctccccacctttgattcactaaatattactgctgcatctttaaatgatgatggattggataatcatactatactgctttactactcaactgctgcttccagtttggctgtaacattgatgatagctatctttattgtttatatggtctccagagacaatgtttcttgctccatctgtcta

SEQ ID NO: 450 - DNA, 1644 bp, Influenza B virus
atgaaggcaataattgtactactcatggtagtaacatccaatgcagatcgaatctgcactgggataacatcgtcaaactcaccccatgtggtcaaaactgctactcaaggggaagtcaatgtgactggtgtgataccactgacaacaacacccaccaaatctcattttgcaaatctcaaaggaacaaaaaccagagggaaactatgcccaaagtgtctcaactgcacagatctggacgtggccttgggcagaccaaagtgcacggggaccataccttcggcaaaagcttcaatactccacgaagtcaaacctgttacatctgggtgctttcctataatgcacgacagaacaaaaattagacagctacccaatcttctcagaggatacgaacatatcaggttatcaacccataacgttatcaacgcagaaacggcaccaggaggaccctacaaagttggaacctcagggtcttgccctaacgttaccaatggaaacggattcttcgcaacaatggcttgggctgtcccaaaaaacgacaacaacaaaacagcaacaaatccattaacagtagaagtaccatacatttgtacagaaggagaagaccaaattactgtttgggggttccactctgataacgaagcccaaatggtaaaactctatggagactcaaagcctcagaagttcacctcatctgccaacggagtgaccacacattacgtttcacagattggtggcttcccaaatcaagcagaagacggagggctaccacaaagcggtagaattgttgttgattacatggtgcaaaaatctggaaaaacaggaacaattacctaccaaagaggtattttattgcctcaaaaagtgtggtgcgcaagtggcaggagcaaggtaataaaagggtccttgcctttaattggcgaagcagattgcctccacgaaaaatacggtggattaaacaaaagcaagccttactacacaggggaacatgcaaaagccataggaaattgcccaatatgggtgaaaacacccttgaagctggccaatggaaccaaatatagacctcctgcaaaactattaaaggaaaagggtttcttcggagctattgctggtttcttagaaggaggatgggaaggaatgattgcaggttggcacggatacacatcccatggagcacatggagtagcagtggcagcagaccttaagagtacgcaagaagccataaacaagataacaaaaaatctcaattctttgagtgagctggaagtaaagaatcttcaaagactaagcggtgccatggatgaactccacaacaaaatactcgaactggatgagaaagtggatgatctcagagctgatacaataagctcgcaaatagagctcgcagtcttgctttccaacgaaggaataataaacagtgaagatgagcatctcttggcgcttgaaagaaaactgaagaaaatgctgggcccctctgctgtagagatagggaatggatgcttcgaaaccaaacacaagtgcaaccagacctgcctcgacagaatagctgctggcacctttaatgcaggagaattttctctccccacctttgattcactaaatattactgctgcatctttaaatgatgatggattggataatcatact

SEQ ID NO: 451 - DNA, 1755 bp, Influenza B virus
atgaaggcaataattgtactactcatggtagtaacatccaatgcagatcgaatctgcactgggataacatcgtcaaactcaccacatgtcgtcaaaactgctactcaaggggaggtcaatgtgactggtgtaataccactgacaacaacacccaccaaatctcattttgcaaatctcaaaggaacagaaaccagggggaaactatgcccaaaatgcctcaactgcacagatctggacgtagccttgggcagaccaaaatgcacggggaaaataccctcggcaagagtttcaatactccatgaagtcagacctgttacatctgggtgctttcctataatgcacgacagaacaaaaattagacagctgcctaaccttctccgaggatacgaacatatcaggttatcaacccataacgttatcaatgcagaaaatgcaccaggaggaccctacaaaattggaacctcagggtcttgccctaacattaccaatggaaacggatttttcgcaacaatggcttgggccgtcccaaaaaacgacaaaaacaaaacagcaacaaatccattaacaatagaagtaccatacatttgtacagaaggagaagaccaaattaccgtttgggggttccactctgacgacgagacccaaatggcaaagctctatggggactcaaagccccagaagttcacctcatctgccaacggagtgaccacacattacgtttcacagattggtggcttcccaaatcaaacagaagacggaggactaccacaaagtggtagaattgttgttgattacatggtgcaaaaatctgggaaaacaggaacaattacctatcaaaggggtattttattgcctcaaaaggtgtggtgcgcaagtggcaggagcaaggtaataaaaggatccttgcctttaattggagaagcagattgcctccacgaaaaatacggtggattaaacaaaagcaagccttactacacaggggaacatgcaaaggccataggaaattgcccaatatgggtgaaaacacccttgaagctggccaatggaaccaaatatagacctcctgcaaaactattaaaggaaaggggtttcttcggagctattgctggtttcttagaaggaggatgggaaggaatgattgcaggttggcacggatacacatcccatggggcacatggagtagcggtggcagcagaccttaagagcactcaagaggccataaacaagataacaaaaaatctcaactctttgagtgagctggaagtaaagaatcttcaaagactaagcggtgccatggatgaactccacaacgaaatactagaactagatgagaaagtggatgatctcagagctgatacaataagctcacaaatagaactcgcagtcctgctttccaatgaaggaataataaacagtgaagatgaacatctcttggcgcttgaaagaaagctgaagaaaatgctgggcccctctgctgtagagatagggaatggatgctttgaaaccaaacacaagtgcaaccagacctgtctcgacagaatagctgctggtacctttgatgcaggagaattttctctccccacctttgattcactgaatattactgctgcatctttaaatgacgatggattggataatcatactatactgctttactactcaactgctgcctccagtttggctgtaacactgatgatagctatctttgttgtttatatggtctccagagacaatgtttcttgctccatctgtcta

SEQ ID NO: 452 - DNA, 1644 bp, Influenza B virus
atgaaggcaataattgtactactcatggtagtaacatccaatgcagatcgaatctgcactgggataacatcgtcaaactcaccacatgtcgtcaaaactgctactcaaggggaggtcaatgtgactggtgtaataccactgacaacaacacccaccaaatctcattttgcaaatctcaaaggaacagaaaccagggggaaactatgcccaaaatgcctcaactgcacagatctggacgtagccttgggcagaccaaaatgcacggggaaaataccctcggcaagagtttcaatactccatgaagtcagacctgttacatctgggtgctttcctataatgcacgacagaacaaaaattagacagctgcctaaccttctccgaggatacgaacatatcaggttatcaacccataacgttatcaatgcagaaaatgcaccaggaggaccctacaaaattggaacctcagggtcttgccctaacattaccaatggaaacggatttttcgcaacaatggcttgggccgtcccaaaaaacgacaaaaacaaaacagcaacaaatccattaacaatagaagtaccatacatttgtacagaaggagaagaccaaattaccgtttgggggttccactctgacgacgagacccaaatggcaaagctctatggggactcaaagccccagaagttcacctcatctgccaacggagtgaccacacattacgtttcacagattggtggcttcccaaatcaaacagaagacggaggactaccacaaagtggtagaattgttgttgattacatggtgcaaaaatctgggaaaacaggaacaattacctatcaaaggggtattttattgcctcaaaaggtgtggtgcgcaagtggcaggagcaaggtaataaaaggatccttgcctttaattggagaagcagattgcctccacgaaaaatacggtggattaaacaaaagcaagccttactacacaggggaacatgcaaaggccataggaaattgcccaatatgggtgaaaacacccttgaagctggccaatggaaccaaatatagacctcctgcaaaactattaaaggaaaggggtttcttcggagctattgctggtttcttagaaggaggatgggaaggaatgattgcaggttggcacggatacacatcccatggggcacatggagtagcggtggcagcagaccttaagagcactcaagaggccataaacaagataacaaaaaatctcaactctttgagtgagctggaagtaaagaatcttcaaagactaagcggtgccatggatgaactccacaacgaaatactagaactagatgagaaagtggatgatctcagagctgatacaataagctcacaaatagaactcgcagtcctgctttccaatgaaggaataataaacagtgaagatgaacatctcttggcgcttgaaagaaagctgaagaaaatgctgggcccctctgctgtagagatagggaatggatgctttgaaaccaaacacaagtgcaaccagacctgtctcgacagaatagctgctggtacctttgatgcaggagaattttctctccccacctttgattcactgaatattactgctgcatctttaaatgacgatggattggataatcatact

SEQ ID NO: 453 - DNA, 1752 bp, Influenza B virus
atgaaggcaataattgtactactcatggtagtaacatccaatgcagatcgaatctgcactgggataacatcttcaaactcacctcatgtggtcaaaacagctactcaaggggaggtcaatgtgactggcgtgataccactgacaacaacaccaacaaaatcttattttgcaaatctcaaaggaacaaggaccagagggaaactatgcccggactgtctcaactgtacagatctggatgtggccttgggcaggccaatgtgtgtggggaccacaccttctgctaaagcttcaatactccacgaggtcagacctgttacatccgggtgctttcctataatgcacgacagaacaaaaatcaggcaactacccaatcttctcagaggatatgaaaagatcaggttatcaacccaaaacgttatcgatgcagaaaaagcaccaggaggaccctacagacttggaacctcaggatcttgccctaacgctaccagtaaaatcggatttttcgcaacaatggcttgggctgtcccaaaggacaactacaaaaatgcaacgaacccactaacagtagaagtaccatacatttgtacagaaggggaagaccaaattactgtttgggggttccattcagacaacaaaacccaaatgaagagcctctatggagactcaaatcctcaaaagttcacctcatctgctaatggagtaaccacacattatgtttctcagattggcgacttcccagatcaaacagaagacggaggactaccacaaagcggcagaattgttgttgattacatgatgcaaaaacctgggaaaacaggaacaattgtctatcaaagaggtgttttgttgcctcaaaaggtgtggtgcgcgagtggcaggagcaaagtaataaaagggtcattgcctttaattggtgaagcagattgccttcatgaaaaatacggtggattaaacaaaagcaagccttactacacaggagaacatgcaaaagccataggaaattgcccaatatgggtaaaaacacctttgaagcttgccaatggaaccaaatatagacctcctgcaaaactattgaaggaaaggggtttcttcggagctattgctggtttcctagaaggaggatgggaaggaatgattgcaggttggcacggatacacatctcacggagcacatggagtggcagtggcggcagaccttaagagtacacaagaagctataaataagataacaaaaaatctcaattctttgagtgagctagaagtaaagaaccttcaaagactaagtggtgccatggatgaactccacaacgaaatactcgagctggatgagaaagtggatgatctcagagctgacactataagctcacaaatagaacttgcagtcttgctttccaacgaaggaataataaacagtgaagacgagcatctattggcacttgagagaaaactaaagaaaatgctgggtccctctgctgtagacataggaaacggatgcttcgaaaccaaacacaaatgcaaccagacctgcttagacaggatagctgctggcacctttgatgcaggagaattttctctccccacttttgattcattgaacattactgctgcatctttaaatgatgatggattggataaccatactatactgctctattactcaactgctgcttctagtttggctgtaacattaatgctagctatttttattgtttatatggtctccagagacaacgtttcatgctccatctgtcta

SEQ ID NO: 454 - DNA, 1778 bp, Influenza A virus
agcaaaagcaggggaaaataaaaacaaccaaaatgaaggcaaacctactggtcctgttatgtgcacttgcagctgcagatgcagacacaatatgtataggctaccatgcgaacaattcaaccgacactgttgacacagtgctcgagaagaatgtgacagtgacacactctgttaacctgctcgaagacagccacaacggaaaactatgtagattaaaaggaatagccccactacaattggggaaatgtaacatcgccggatggctcttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaccaaaggagtaacggcagcatgctcccatgcggggaaaagcagtttttacagaaatttgctatggctgacggagaaggagggctcatacccaaagctgaaaaattcttatgtgaacaagaaagggaaagaagtccttgtactgtggggtattcatcacccgtctaacagtaaggatcaacagaatatctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaaggtatgctttcgcactgagtagaggctttgggtccggcatcatcacctcaaacgcatcaatgcatgagtgtaacacgaagtgtcaaacacccctgggagctataaacagcagtctccctttccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtacggttatcatcatcagaatgaacagggatcaggctatgcagcggatcaaaaaagcacacaaaatgccattaacgggattacaaacaaggtgaactctgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcagattctggcgatctactcaactgtcgccagttcactggtgcttttggtctccctgggggcaatcagtttctggatgtgttctaatggatctttgcagtgcagaatatgcatctgagattagaatttcagaaatatgaggaaaaacacccttgtttctact

SEQ ID NO: 455 - DNA, 1732 bp, Influenza A virus
agcgaaagcaggggatacaaaatgaacactcaaatcctggtattcgctctgattgcgatcattccaacaaatgcagacaaaatctgcctcggacatcatgccgtgtcaaacggaaccaaagtaaacacattaactgaaagaggagtggaagtcgtcaatgcaactgaaacagtggaacgaacaaacatccccaggatctgctcaaaagggaaaaggacagttgacctcggtcaatgtggactcctggggacaatcactggaccacctcaatgtgaccaattcctagaattttcagccgatttaattattgagaggcgagaaggaagtgatgtctgttatcctgggaaattcgtgaatgaagaagctctgaggcaaattctcagagaatcaggcggaattgacaaggaagcaatgggattcacatacagtggaataagaactaatggagcaaccagtgcatgtaggagatcaggatcttcattctatgcagaaatgaaatggctcctgtcaaacacagatgatgctgcattcccgcagatgactaagtcatataaaaatacaagaaaaagcccagctctaatagtatgggggatccatcattccgtatcaactgcagagcaaaccaagctatatgggagtggaaacaaactggtgacagttgggagttctaattatcaacaatcttttgtaccgagtccaggagcgagaccacaagttaatggtctatctggaagaattgactttcattggctaatgctaaatcccaatgatacagtcactttcagtttcaatggggctttcatagctccagaccgtgcaagcttcctgagaggaaaatctatgggaatccagagtggagtacaggttgatgccaattgtgaaggggactgctatcatagtggagggacaataataagtaacttgccatttcagaacatagatagcagggcagttggaaaatgtccgagatatgttaagcaaaggagtctgctgctagcaacagggatgaagaatgttcctgagattccaaagggaagaggcctatttggtgctatagcgggtttcattgaaaatggatgggaaggcctaattgatggttggtatggtttcagacaccagaatgcacagggagagggaactgctgcagattacaaaagcactcaatcggcaattgatcaaataacaggaaaattaaaccggcttatagaaaaaaccaaccaacaatttgagttgatagacaatgaattcaatgaggtagagaagcaaatcggtaatgtgataaattggaccagagattctataacagaagtgtggtcatacaatgctgaactcttggtagcaatggagaaccagcatacaattgatctggctgattcagaaatggacaaactgtacgaacgagtgaaaagacagctgagagagaatgctgaagaagatggcactggttgctttgaaatatttcacaagtgtgatgatgactgtatggccagtattagaaataacacctatgatcacagcaaatacagggaagaggcaatgcaaaatagaatacagattgacccagtcaaactaagcagcggctacaaagatgtgatactttggtttagcttcggggcatcatgtttcatacttctagccattgtaatgggccttgtcttcatatgtgtaaagaatggaaacatgcggtgcactatttgtatataagtttggaaaaaaacacccttgtttctac

SEQ ID NO: 456 - DNA, 1686 bp, Influenza A virus
atgtacaaaatagtagtgataatcgcgctccttggagctgtgaaaggtcttgataaaatctgtctaggacatcatgcagtggctaatgggaccatcgtaaagactctcacaaacgaacaggaagaggtaaccaacgctactgaaacagtggagagtacaggcataaacagattatgtatgaaaggaagaaaacataaagacctgggcaactgccatccaatagggatgctaatagggactccagcttgtgatctgcaccttacagggatgtgggacactctcattgaacgagagaatgctattgcttactgctaccctggagctactgtaaatgtagaagcactaaggcagaagataatggagagtggagggatcaacaagataagcactggcttcacttatggatcttccataaactcggccgggaccactagagcgtgcatgaggaatggagggaatagcttttatgcagagcttaagtggctggtatcaaagagcaaaggacaaaacttccctcagaccacgaacacttacagaaatacagacacggctgaacacctcataatgtggggaattcatcacccttctagcactcaagagaagaatgatctatatggaacacaatcactgtccatatcagtcgggagttccacttaccggaacaattttgttccggttgttggagcaagacctcaggtcaatggacaaagtggcagaattgattttcactggacactagtacagccaggtgacaacatcaccttctcacacaatgggggcctgatagcaccgagccgagttagcaaattaattgggaggggattgggaatccaatcagacgcaccaatagacaataattgtgagtccaaatgtttttggagagggggttctataaatacaaggcttccctttcaaaatttgtcaccaagaacagtgggtcagtgtcctaaatatgtgaacagaagaagcttgatgcttgcaacaggaatgagaaacgtaccagaactaatacaagggagaggtctatttggtgcaatagcagggtttttagagaatgggtgggaaggaatggtagatggctggtatggtttcagacatcaaaatgctcagggcacaggccaggccgctgattacaagagtactcaggcagctattgatcaaatcactgggaaactgaatagacttgttgaaaaaaccaatactgagttcgagtcaatagaatctgagttcagtgagatcgaacaccaaatcggtaacgtcatcaattggactaaggattcaataaccgacatttggacttatcaggctgagctgttggtggcaatggagaaccagcatacaatcgacatggctgactcagagatgttgaatctatatgaaagagtgaggaaacaactaaggcagaatgcagaagaagatgggaaaggatgttttgagatatatcatgcttgtgatgattcatgcatggagagcataagaaacaacacctatgaccattcacagtacagagaggaagctcttttgaacagattgaatatcaacccagtgacactctcttctggatataaagacatcattctctggtttagcttcggggcatcatgttttgttcttctagccgttgtcatgggtcttttctttttctgtctgaagaatggaaacatgcgatgcacaatctgtatttag

SEQ ID NO: 457 - DNA, 1494 bp, Artificial Sequence
  Synthetic Polynucleotide
atggccagccagggcaccaagagaagctacgagcagatggagaccgacggcgagagacagaacgccaccgagatcagagccagcgtgggcaagatgatcgacggcatcggcagattctacatccagatgtgcaccgagctcaagctgagcgactacgagggcagactgatccagaacagcctgaccatcgaaagaatggttctgagcgccttcgacgagagaagaaacagatacctggaggagcaccccagcgccggcaaggaccccaagaagaccggcggccccatctacaagagagtggacggcagatggatgagagagctggtgctgtacgacaaggaggagatcagaagaatctggagacaggccaacaacggcgacgacgccaccgccggcctgacccacatgatgatctggcacagcaacctgaacgacaccacctaccagagaaccagagccctggtgagaaccggcatggaccccagaatgtgcagcttaatgcagggcagcaccctgcccagaagatccggcgccgctggtgccgccgtcaagggcatcggcaccatggtgatggagctgatccgcatgatcaagcgcggcatcaacgacagaaacttctggagaggcgaaaacggcagaaagaccagaagcgcctacgagagaatgtgcaacatcctgaagggcaagttccagaccgccgcccaaagagccatgatggaccaggtgagagagagcagaaaccccggcaacgccgagatcgaagacctgatcttcagcgccagatcggccctgatcctgagaggcagcgtggcccacaagagctgcctgcccgcctgcgtgtatggccccgccgtgagcagcggctacaacttcgagaaggagggctacagcctggtgggcatcgaccccttcaagctgctgcagaactctcaggtgtatagcctgatcagacccaacgagaaccccgcccacaagagccagctggtgtggatggcctgccacagcgccgccttcgaggacctgagactgctgagcttcatcagaggtaccaaggtgtcccccagaggcaagctgagcaccagaggtgtgcagatcgccagcaatgagaacatggacaatatggagagcagcaccctggagctaagaagcaggtactgggccatccggaccagaagcggcggcaataccaaccagcagagagccagcgccggccagatcagcgtgcagcccaccttcagcgtgcagagaaacctgccctttgagaagagcaccgtgatggccgccttcaccggcaacaccgagggcagaaccagcgacatgagagccgagatcatcagaatgatggagggcgccaagcccgaggaggtgagctttagaggcagaggcgtgttcgagctgagcgacgagaaggccaccaacccaattgtgcccagcttcgacatgtcgaacgagggcagctacttcttcggcgacaacgccgaggagtacgacaac

SEQ ID NO: 458 - protein, 498 aa, Artificial Sequence; identical to SEQ ID NO: 421
  Synthetic Polypeptide

SEQ ID NO: 459 - DNA, 798 bp, Artificial Sequence
  Synthetic Polynucleotide
atggagacccccgcccagctgctgttcctgctgctgctgtggctgcccgacaccaccggcgacaccatctgcatcggctaccacgccaacaacagcaccgacaccgtggacaccgtgctggagaagaacgtgaccgtgacccacagcgtgaacctgggcagcggcctgaggatggtgaccggcctgaggaacatcccccagagggagaccaggggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacatggtgaacagcgtgatcgagaagatgggcagcggcggcagcggcaccgacctggccgagctgctggtgctgctgctgaacgagaggaccctggacttccacgacagcaacgtgaagaacctgtacgagaaggtgaagagccagctgaagaacaacgccaaggagatcggcaacggctgcttcgagttctaccacaagtgcaacaacgagtgcatggagagcgtgaagaacggcacctacgactaccccaagtacagcgaggagagcaagctgaacagggagaagatcgacggagtgaaattggaatcaatgggggtctatcagatcctggccatctacagcaccgtggccagcagcctggtgctgctggtgagcctgggcgccatcagcttctggatgtgcagcaacggcagcctgcagtgcagaatctgcatc

SEQ ID NO: 460 - protein, 266 aa, Artificial Sequence
  Synthetic Polypeptide
METPAQLLFLLLLWLPDTTGDTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 461 - DNA, 744 bp, Artificial Sequence
  Synthetic Polynucleotide
atggagacccccgcccagctgctgttcctgctgctgctgtggctgcccgacaccaccggcgacaccatctgcatcggctaccacgccaacaacagcaccgacaccgtggacaccgtgctggagaagaacgtgaccgtgacccacagcgtgaacctgggcagcggcctgaggatggtgaccggcctgaggaacatcccccagagggagaccaggggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacatggtgaacagcgtgatcgagaagatgggcagcggcggcagcggcaccgacctggccgagctgctggtgctgctgctgaacgagaggaccctggacttccacgacagcaacgtgaagaacctgtacgagaaggtgaagagccagctgaagaacaacgccaaggagatcggcaacggctgcttcgagttctaccacaagtgcaacaacgagtgcatggagagcgtgaagaacggcacctacgactaccccaagtacagcgaggagagcaagctgaacagggagaagatcgaccccggcagcggctacatccccgaggcccccagggacggccaggcctacgtgaggaaggacggcgagtgggtgctgctgagcaccttcctg

SEQ ID NO: 462 - protein, 248 aa, Artificial Sequence; identical to SEQ ID NO: 433
  Synthetic Polypeptide

SEQ ID NO: 463 - protein, 191 aa, Artificial Sequence; identical to SEQ ID NO: 441
  Synthetic Polypeptide

SEQ ID NO: 464 - protein, 160 aa, Artificial Sequence; identical to SEQ ID NO: 443
  Synthetic Polypeptide

SEQ ID NO: 465 - protein, 260 aa, Artificial Sequence
  Synthetic Polypeptide
METPAQLLFLLLLWLPDTTGDTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDQGTGGILAIYSTVASSLVLLVSLGAISFWMCSNGSLQCRICI

SEQ ID NO: 466 - protein, 266 aa, Artificial Sequence; identical to SEQ ID NO: 460
  Synthetic Polypeptide

SEQ ID NO: 467 - protein, 328 aa, Artificial Sequence
  Synthetic Polypeptide
METPAQLLFLLLLWLPDTTGDTVDTVCEKNVTVTHSVNLLEDSHGSANSSLPYQNTHPTTNGESPKYVRSAKLRMVTGLRNGSAGSATQNAINCITNKVNTVIEKMNIQDTATGKEFNKDEKRMENLNKKVDDGFLDIWTYNAELLVLLENERTLDAHDSQGTGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 468 - protein, 566 aa, Artificial Sequence
  Synthetic Polypeptide
MKAKLLVLLCAFTATDADTICIGYHANNSTDTVDTVLEKNVTVTHSVNLLEDSHNGKLCKLKGIAPLQLGKCNIAGWILGNPECESLISKRSWSYIVETPNSENGTCYPGDFADYEELREQLSSVSSFERFEIFPKESSWPNHNVTKGVTAACSHAGKSSFYRNLLWLTEKNGSYPKLSKSYVNNKEKEVLVLWGVHHPSNITDQRTLYQNENAYVSVVSSHYNRRFTPEIAKRPKVRGQAGRINYYWTLLEPGDTIIFEANGNLIAPWYAFALSRGFGSGIITSNAPMHECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 469 - protein, 566 aa, Artificial Sequence
  Synthetic Polypeptide
MKTIIALSYIFCLVFAQKLPGNDNSTATLCLGHHAVPNGTLVKTITNDQIEVTNATELVQSSSTGRICDSPHRILDGTNCTLIDALLGDPHCDGFQNKEWDLFVERSKAYSNCYPYDVPDYASLRSLVASSGTLEFNNEGFNWTGVTQNGGSSACKRGSDKSFFSRLNWLHKLKYKYPALNVTMPNNDKFDKLYIWGVHHPSTDSDQTSLYVQASGRVTVSTKRSQQTVIPNIGSRPWVRGLSSRISIYWTIVKPGDILLINSTGNLIAPRGYFKIRSGKSSIMRSDAPIGTCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 470 - protein, 566 aa, Artificial Sequence
  Synthetic Polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 471 - protein, 565 aa, Artificial Sequence
  Synthetic Polypeptide
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 472 - protein, 566 aa, Artificial Sequence
  Synthetic Polypeptide
MKARLLVLLCALAATDADTICIGYHANNSTDTVDTVLEKNVTVTHSVNLLEDSHNGKLCKLKGIAPLQLGKCNIAGWLLGNPECESLLSARSWSYIVETPNSENGTCYPGDFIDYEELREQLSSVSSFERFEIFPKESSWPNHNTTKGVTAACSHAGKSSFYRNLLWLTKKGGSYPKLSKSYVNNKGKEVLVLWGVHHPSTSTDQQSLYQNENAYVSVVSSNYNRRFTPEIAERPKVRGQAGRMNYYWTLLEPGDTIIFEATGNLIAPWYAFALSRGSGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLRNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 473 - protein, 566 aa, Artificial Sequence
  Synthetic Polypeptide
MEARLLVLLCAFAATNADTICIGYHANNSTDTVDTVLEKNVTVTHSVNLLEDSHNGKLCRLKGIAPLQLGNCSVAGWILGNPECESLFSKESWSYIAETPNPENGTCYPGYFADYEELREQLSSVSSFERFEIFPKESSWPNHTVTKGVTASCSHNGKSSFYRNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 474 - protein, 684 aa, Artificial Sequence
  Synthetic Polypeptide
MKAKLLVLLCAFTATDADTICIGYHANNSTDTVDTVLEKNVTVTHSVNLLEDSHNGKLCKLKGIAPLQLGKCNIAGWILGNPECESLISKRSWSYIVETPNSENGTCYPGDFADYEELREQLSSVSSFERFEIFPKESSWPNHNVTKGVTAACSHAGKSSFYRNLLWLTEKNGSYPKLSKSYVNNKEKEVLVLWGVHHPSNITDQRTLYQNENAYVSVVSSHYNRRFTPEIAKRPKVRGQAGRINYYWTLLEPGDTIIFEANGNLIAPWYAFALSRGFGSGIITSNAPMHECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 475 - protein, 685 aa, Artificial Sequence
  Synthetic Polypeptide
MKTIIALSYIFCLVFAQKLPGNDNSTATLCLGHHAVPNGTLVKTITNDQIEVTNATELVQSSSTGRICDSPHRILDGTNCTLIDALLGDPHCDGFQNKEWDLFVERSKAYSNCYPYDVPDYASLRSLVASSGTLEFNNEGFNWTGVTQNGGSSACKRGSDKSFFSRLNWLHKLKYKYPALNVTMPNNDKFDKLYIWGVHHPSTDSDQTSLYVQASGRVTVSTKRSQQTVIPNIGSRPWVRGLSSRISIYWTIVKPGDILLINSTGNLIAPRGYFKIRSGKSSIMRSDAPIGTCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 476 - protein, 684 aa, Artificial Sequence
  Synthetic Polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 477 - protein, 683 aa, Artificial Sequence
  Synthetic Polypeptide
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 478 - protein, 684 aa, Artificial Sequence
  Synthetic Polypeptide
MKARLLVLLCALAATDADTICIGYHANNSTDTVDTVLEKNVTVTHSVNLLEDSHNGKLCKLKGIAPLQLGKCNIAGWLLGNPECESLLSARSWSYIVETPNSENGTCYPGDFIDYEELREQLSSVSSFERFEIFPKESSWPNHNTTKGVTAACSHAGKSSFYRNLLWLTKKGGSYPKLSKSYVNNKGKEVLVLWGVHHPSTSTDQQSLYQNENAYVSVVSSNYNRRFTPEIAERPKVRGQAGRMNYYWTLLEPGDTIIFEATGNLIAPWYAFALSRGSGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLRNNAKEIGNGCFEFYHKCDNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 479 - protein, 684 aa, Artificial Sequence
  Synthetic Polypeptide
MEARLLVLLCAFAATNADTICIGYHANNSTDTVDTVLEKNVTVTHSVNLLEDSHNGKLCRLKGIAPLQLGNCSVAGWILGNPECESLFSKESWSYIAETPNPENGTCYPGYFADYEELREQLSSVSSFERFEIFPKESSWPNHTVTKGVTASCSHNGKSSFYRNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 480 - protein, 20 aa, Artificial Sequence
  Synthetic Polypeptide
METPAQLLFLLLLWLPDTTG

SEQ ID NO: 481 - protein, 18 aa, Artificial Sequence
  Synthetic Polypeptide
MDWTWILFLVAAATRVHS

SEQ ID NO: 482 - protein, 24 aa, Artificial Sequence
  Synthetic Polypeptide
MLGSNSGQRVVFTILLLLVAPAYS

SEQ ID NO: 483 - protein, 17 aa, Artificial Sequence
  Synthetic Polypeptide
MKCLLYLAFLFIGVNCA

SEQ ID NO: 484 - protein, 15 aa, Artificial Sequence
  Synthetic Polypeptide
MWLVSLAIVTACAGA

SEQ ID NO: 485 - DNA, 1729 bp, Artificial Sequence
  Synthetic Polynucleotide
tcaagcttttggaccctcgtacagaagctaatacgactcactatagggaaataagagagaaaagaagagtaagaagaaatataagagccaccatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttgataataggctggagcctcggtggccatgcttcttgccccttgggcctccccccagcccctcctccccttcctgcacccgtacccccgtggtctttgaataaagtctgagtgggcggc

SEQ ID NO: 486 - DNA, 1518 bp, Artificial Sequence
  Synthetic Polynucleotide
atggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgt

SEQ ID NO: 487 - RNA, 1790 nt, Artificial Sequence
  Synthetic Polynucleotide
ggggaaauaagagagaaaagaagaguaagaagaaauauaagagccaccauggcacaagucauuaauacaaacagccugucgcuguugacccagaauaaccugaacaaaucccaguccgcacugggcacugcuaucgagcguuugucuuccggucugcguaucaacagcgcgaaagacgaugcggcaggacaggcgauugcuaaccguuuuaccgcgaacaucaaaggucugacucaggcuucccguaacgcuaacgacgguaucuccauugcgcagaccacugaaggcgcgcugaacgaaaucaacaacaaccugcagcgugugcgugaacuggcgguucagucugcgaaugguacuaacucccagucugaccucgacuccauccaggcugaaaucacccagcgccugaacgaaaucgaccguguauccggccagacucaguucaacggcgugaaaguccuggcgcaggacaacacccugaccauccagguuggugccaacgacggugaaacuaucgauauugauuuaaaagaaaucagcucuaaaacacugggacuugauaagcuuaauguccaagaugccuacaccccgaaagaaacugcuguaaccguugauaaaacuaccuauaaaaaugguacagauccuauuacagcccagagcaauacugauauccaaacugcaauuggcgguggugcaacggggguuacuggggcugauaucaaauuuaaagauggucaauacuauuuagauguuaaaggcggugcuucugcugguguuuauaaagccacuuaugaugaaacuacaaagaaaguuaauauugauacgacugauaaaacuccguuggcaacugcggaagcuacagcuauucggggaacggccacuauaacccacaaccaaauugcugaaguaacaaaagaggguguugauacgaccacaguugcggcucaacuugcugcagcagggguuacuggcgccgauaaggacaauacuagccuuguaaaacuaucguuugaggauaaaaacgguaagguuauugaugguggcuaugcagugaaaaugggcgacgauuucuaugccgcuacauaugaugagaaaacaggugcaauuacugcuaaaaccacuacuuauacagaugguacuggcguugcucaaacuggagcugugaaauuugguggcgcaaaugguaaaucugaaguuguuacugcuaccgaugguaagacuuacuuagcaagcgaccuugacaaacauaacuucagaacaggcggugagcuuaaagagguuaauacagauaagacugaaaacccacugcagaaaauugaugcugccuuggcacagguugauacacuucguucugaccugggugcgguucagaaccguuucaacuccgcuaucaccaaccugggcaauaccguaaauaaccugucuucugcccguagccguaucgaagauuccgacuacgcaaccgaagucuccaacaugucucgcgcgcagauucugcagcaggccgguaccuccguucuggcgcaggcgaaccagguuccgcaaaacguccucucuuuacugcguugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 488 - protein, 506 aa, Artificial Sequence
  Synthetic Polypeptide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDPITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKTGAITAKTTTYTDGTGVAQTGAVKFGGANGKSEVVTATDGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 489 - protein, 698 aa, Artificial Sequence
  Synthetic Polypeptide
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLRGGGGSGGGGSMMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSVTCGNGIQVRIKPGSANKPKDELDYENDIEKKICKMEKCSSVFNVVNS

SEQ ID NO: 490 - protein, 692 aa, Artificial Sequence
  Synthetic Polypeptide
MMAPDPNANPNANPNANPNANPNANPNANPNANPNANPNANPNANPNANPNANPNANPNANPNANPNANPNANPNANPNANPNKNNQGNGQGHNMPNDPNRNVDENANANNAVKNNNNEEPSDKHIEQYLKKIKNSISTEWSPCSVTCGNGIQVRIKPGSANKPKDELDYENDIEKKICKMEKCSSVFNVVNSRPVTMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 491 - RNA, 1749 nt, Influenza B virus
augaaggcaauaauuguacuacucaugguaguaacauccaacgcagaucgaaucugcacugggauaacaucuucaaacucaccucauguggucaaaacagcuacucaaggggaaguuaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauggggaccauaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccauaacguuaucaacgcagaaagggcaccaggaggacccuacagacuuggaaccucaggaucuugcccuaacguuaccaguagaaacggauucuucgcaacaauggcuugggcugucccaagggacaacaaaacagcaacgaauccacuaacaguagaaguaccauacauuugcacaaaaggagaagaccaaauuacuguuuggggguuccauucugaugacaaaacccaaaugaaaaaccucuauggagacucaaauccucaaaaguucaccucaucugccaauggaguaaccacacauuauguuucucagauuggugacuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagagggaggaugggaaggaaugauugcagguuggcacggauacacaucucauggagcacauggaguggcaguggcagcagaccuuaagagcacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggccguaacauugaugauagcuauuuuuauuguuuauauggucuccagagacaauguuucuugcuccaucugucua

SEQ ID NO: 492 - RNA, 1638 nt, Influenza B virus
augaaggcaauaauuguacuacucaugguaguaacauccaacgcagaucgaaucugcacugggauaacaucuucaaacucaccucauguggucaaaacagcuacucaaggggaaguuaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauggggaccauaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccauaacguuaucaacgcagaaagggcaccaggaggacccuacagacuuggaaccucaggaucuugcccuaacguuaccaguagaaacggauucuucgcaacaauggcuugggcugucccaagggacaacaaaacagcaacgaauccacuaacaguagaaguaccauacauuugcacaaaaggagaagaccaaauuacuguuuggggguuccauucugaugacaaaacccaaaugaaaaaccucuauggagacucaaauccucaaaaguucaccucaucugccaauggaguaaccacacauuauguuucucagauuggugacuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagagggaggaugggaaggaaugauugcagguuggcacggauacacaucucauggagcacauggaguggcaguggcagcagaccuuaagagcacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacu

SEQ ID NO: 493 - RNA, 1755 nt, Influenza B virus
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaagugucucaacugcacagaucuggacguggccuugggcagaccaaagugcacggggaccauaccuucggcaaaagcuucaauacuccacgaagucaaaccuguuacaucugggugcuuuccuauaaugcacgacagaacaaaaauuagacagcuacccaaucuucucagaggauacgaacauaucagguuaucaacccauaacguuaucaacgcagaaacggcaccaggaggacccuacaaaguuggaaccucagggucuugcccuaacguuaccaauggaaacggauucuucgcaacaauggcuugggcugucccaaaaaacgacaacaacaaaacagcaacaaauccauuaacaguagaaguaccauacauuuguacagaaggagaagaccaaauuacuguuuggggguuccacucugauaacgaagcccaaaugguaaaacucuauggagacucaaagccucagaaguucaccucaucugccaacggagugaccacacauuacguuucacagauugguggcuucccaaaucaagcagaagacggagggcuaccacaaagcgguagaauuguuguugauuacauggugcaaaaaucuggaaaaacaggaacaauuaccuaccaaagagguauuuuauugccucaaaaaguguggugcgcaaguggcaggagcaagguaauaaaaggguccuugccuuuaauuggcgaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaaaggguuucuucggagcuauugcugguuucuuagaaggaggaugggaaggaaugauugcagguuggcacggauacacaucccauggagcacauggaguagcaguggcagcagaccuuaagaguacgcaagaagccauaaacaagauaacaaaaaaucucaauucuuugagugagcuggaaguaaagaaucuucaaagacuaagcggugccauggaugaacuccacaacaaaauacucgaacuggaugagaaaguggaugaucucagagcugauacaauaagcucgcaaauagagcucgcagucuugcuuuccaacgaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugaugauggauuggauaaucauacuauacugcuuuacuacucaacugcugcuuccaguuuggcuguaacauugaugauagcuaucuuuauuguuuauauggucuccagagacaauguuucuugcuccaucugucua

SEQ ID NO: 494 - RNA, 1644 nt, Influenza B virus
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaagugucucaacugcacagaucuggacguggccuugggcagaccaaagugcacggggaccauaccuucggcaaaagcuucaauacuccacgaagucaaaccuguuacaucugggugcuuuccuauaaugcacgacagaacaaaaauuagacagcuacccaaucuucucagaggauacgaacauaucagguuaucaacccauaacguuaucaacgcagaaacggcaccaggaggacccuacaaaguuggaaccucagggucuugcccuaacguuaccaauggaaacggauucuucgcaacaauggcuugggcugucccaaaaaacgacaacaacaaaacagcaacaaauccauuaacaguagaaguaccauacauuuguacagaaggagaagaccaaauuacuguuuggggguuccacucugauaacgaagcccaaaugguaaaacucuauggagacucaaagccucagaaguucaccucaucugccaacggagugaccacacauuacguuucacagauugguggcuucccaaaucaagcagaagacggagggcuaccacaaagcgguagaauuguuguugauuacauggugcaaaaaucuggaaaaacaggaacaauuaccuaccaaagagguauuuuauugccucaaaaaguguggugcgcaaguggcaggagcaagguaauaaaaggguccuugccuuuaauuggcgaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaaaggguuucuucggagcuauugcugguuucuuagaaggaggaugggaaggaaugauugcagguuggcacggauacacaucccauggagcacauggaguagcaguggcagcagaccuuaagaguacgcaagaagccauaaacaagauaacaaaaaaucucaauucuuugagugagcuggaaguaaagaaucuucaaagacuaagcggugccauggaugaacuccacaacaaaauacucgaacuggaugagaaaguggaugaucucagagcugauacaauaagcucgcaaauagagcucgcagucuugcuuuccaacgaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugaugauggauuggauaaucauacu

SEQ ID NO: 495 - RNA, 1755 nt, Influenza B virus
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacgacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucua

SEQ ID NO: 496 - RNA, 1644 nt, Influenza B virus
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacgacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacu

SEQ ID NO: 497 - RNA, 1752 nt, Influenza B virus
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagacaacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuugaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucua

SEQ ID NO: 498 - RNA, 1778 nt, Influenza A virus
agcaaaagcaggggaaaauaaaaacaaccaaaaugaaggcaaaccuacugguccuguuaugugcacuugcagcugcagaugcagacacaauauguauaggcuaccaugcgaacaauucaaccgacacuguugacacagugcucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaccaaaggaguaacggcagcaugcucccaugcggggaaaagcaguuuuuacagaaauuugcuauggcugacggagaaggagggcucauacccaaagcugaaaaauucuuaugugaacaagaaagggaaagaaguccuuguacugugggguauucaucacccgucuaacaguaaggaucaacagaauaucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaagguaugcuuucgcacugaguagaggcuuuggguccggcaucaucaccucaaacgcaucaaugcaugaguguaacacgaagugucaaacaccccugggagcuauaaacagcagucucccuuuccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguacgguuaucaucaucagaaugaacagggaucaggcuaugcagcggaucaaaaaagcacacaaaaugccauuaacgggauuacaaacaaggugaacucuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucugagauuagaauuucagaaauaugaggaaaaacacccuuguuucuacu

SEQ ID NO: 499 - RNA, 1732 nt, Influenza A virus
agcgaaagcaggggauacaaaaugaacacucaaauccugguauucgcucugauugcgaucauuccaacaaaugcagacaaaaucugccucggacaucaugccgugucaaacggaaccaaaguaaacacauuaacugaaagaggaguggaagucgucaaugcaacugaaacaguggaacgaacaaacauccccaggaucugcucaaaagggaaaaggacaguugaccucggucaauguggacuccuggggacaaucacuggaccaccucaaugugaccaauuccuagaauuuucagccgauuuaauuauugagaggcgagaaggaagugaugucuguuauccugggaaauucgugaaugaagaagcucugaggcaaauucucagagaaucaggcggaauugacaaggaagcaaugggauucacauacaguggaauaagaacuaauggagcaaccagugcauguaggagaucaggaucuucauucuaugcagaaaugaaauggcuccugucaaacacagaugaugcugcauucccgcagaugacuaagucauauaaaaauacaagaaaaagcccagcucuaauaguaugggggauccaucauuccguaucaacugcagagcaaaccaagcuauaugggaguggaaacaaacuggugacaguugggaguucuaauuaucaacaaucuuuuguaccgaguccaggagcgagaccacaaguuaauggucuaucuggaagaauugacuuucauuggcuaaugcuaaaucccaaugauacagucacuuucaguuucaauggggcuuucauagcuccagaccgugcaagcuuccugagaggaaaaucuaugggaauccagaguggaguacagguugaugccaauugugaaggggacugcuaucauaguggagggacaauaauaaguaacuugccauuucagaacauagauagcagggcaguuggaaaauguccgagauauguuaagcaaaggagucugcugcuagcaacagggaugaagaauguuccugagauuccaaagggaagaggccuauuuggugcuauagcggguuucauugaaaauggaugggaaggccuaauugaugguugguaugguuucagacaccagaaugcacagggagagggaacugcugcagauuacaaaagcacucaaucggcaauugaucaaauaacaggaaaauuaaaccggcuuauagaaaaaaccaaccaacaauuugaguugauagacaaugaauucaaugagguagagaagcaaaucgguaaugugauaaauuggaccagagauucuauaacagaaguguggucauacaaugcugaacucuugguagcaauggagaaccagcauacaauugaucuggcugauucagaaauggacaaacuguacgaacgagugaaaagacagcugagagagaaugcugaagaagauggcacugguugcuuugaaauauuucacaagugugaugaugacuguauggccaguauuagaaauaacaccuaugaucacagcaaauacagggaagaggcaaugcaaaauagaauacagauugacccagucaaacuaagcagcggcuacaaagaugugauacuuugguuuagcuucggggcaucauguuucauacuucuagccauuguaaugggccuugucuucauauguguaaagaauggaaacaugcggugcacuauuuguauauaaguuuggaaaaaaacacccuuguuucuac

SEQ ID NO: 500 - RNA, 1686 nt, Influenza A virus
auguacaaaauaguagugauaaucgcgcuccuuggagcugugaaaggucuugauaaaaucugucuaggacaucaugcaguggcuaaugggaccaucguaaagacucucacaaacgaacaggaagagguaaccaacgcuacugaaacaguggagaguacaggcauaaacagauuauguaugaaaggaagaaaacauaaagaccugggcaacugccauccaauagggaugcuaauagggacuccagcuugugaucugcaccuuacagggaugugggacacucucauugaacgagagaaugcuauugcuuacugcuacccuggagcuacuguaaauguagaagcacuaaggcagaagauaauggagaguggagggaucaacaagauaagcacuggcuucacuuauggaucuuccauaaacucggccgggaccacuagagcgugcaugaggaauggagggaauagcuuuuaugcagagcuuaaguggcugguaucaaagagcaaaggacaaaacuucccucagaccacgaacacuuacagaaauacagacacggcugaacaccucauaauguggggaauucaucacccuucuagcacucaagagaagaaugaucuauauggaacacaaucacuguccauaucagucgggaguuccacuuaccggaacaauuuuguuccgguuguuggagcaagaccucaggucaauggacaaaguggcagaauugauuuucacuggacacuaguacagccaggugacaacaucaccuucucacacaaugggggccugauagcaccgagccgaguuagcaaauuaauugggaggggauugggaauccaaucagacgcaccaauagacaauaauugugaguccaaauguuuuuggagaggggguucuauaaauacaaggcuucccuuucaaaauuugucaccaagaacagugggucaguguccuaaauaugugaacagaagaagcuugaugcuugcaacaggaaugagaaacguaccagaacuaauacaagggagaggucuauuuggugcaauagcaggguuuuuagagaaugggugggaaggaaugguagauggcugguaugguuucagacaucaaaaugcucagggcacaggccaggccgcugauuacaagaguacucaggcagcuauugaucaaaucacugggaaacugaauagacuuguugaaaaaaccaauacugaguucgagucaauagaaucugaguucagugagaucgaacaccaaaucgguaacgucaucaauuggacuaaggauucaauaaccgacauuuggacuuaucaggcugagcuguugguggcaauggagaaccagcauacaaucgacauggcugacucagagauguugaaucuauaugaaagagugaggaaacaacuaaggcagaaugcagaagaagaugggaaaggauguuuugagauauaucaugcuugugaugauucaugcauggagagcauaagaaacaacaccuaugaccauucacaguacagagaggaagcucuuuugaacagauugaauaucaacccagugacacucucuucuggauauaaagacaucauucucugguuuagcuucggggcaucauguuuuguucuucuagccguugucaugggucuuuucuuuuucugucugaagaauggaaacaugcgaugcacaaucuguauuuag

SEQ ID NO: 501 - RNA, 1494 nt, Artificial Sequence
  Synthetic Polynucleotide
auggccagccagggcaccaagagaagcuacgagcagauggagaccgacggcgagagacagaacgccaccgagaucagagccagcgugggcaagaugaucgacggcaucggcagauucuacauccagaugugcaccgagcucaagcugagcgacuacgagggcagacugauccagaacagccugaccaucgaaagaaugguucugagcgccuucgacgagagaagaaacagauaccuggaggagcaccccagcgccggcaaggaccccaagaagaccggcggccccaucuacaagagaguggacggcagauggaugagagagcuggugcuguacgacaaggaggagaucagaagaaucuggagacaggccaacaacggcgacgacgccaccgccggccugacccacaugaugaucuggcacagcaaccugaacgacaccaccuaccagagaaccagagcccuggugagaaccggcauggaccccagaaugugcagcuuaaugcagggcagcacccugcccagaagauccggcgccgcuggugccgccgucaagggcaucggcaccauggugauggagcugauccgcaugaucaagcgcggcaucaacgacagaaacuucuggagaggcgaaaacggcagaaagaccagaagcgccuacgagagaaugugcaacauccugaagggcaaguuccagaccgccgcccaaagagccaugauggaccaggugagagagagcagaaaccccggcaacgccgagaucgaagaccugaucuucagcgccagaucggcccugauccugagaggcagcguggcccacaagagcugccugcccgccugcguguauggccccgccgugagcagcggcuacaacuucgagaaggagggcuacagccuggugggcaucgaccccuucaagcugcugcagaacucucagguguauagccugaucagacccaacgagaaccccgcccacaagagccagcugguguggauggccugccacagcgccgccuucgaggaccugagacugcugagcuucaucagagguaccaaggugucccccagaggcaagcugagcaccagaggugugcagaucgccagcaaugagaacauggacaauauggagagcagcacccuggagcuaagaagcagguacugggccauccggaccagaagcggcggcaauaccaaccagcagagagccagcgccggccagaucagcgugcagcccaccuucagcgugcagagaaaccugcccuuugagaagagcaccgugauggccgccuucaccggcaacaccgagggcagaaccagcgacaugagagccgagaucaucagaaugauggagggcgccaagcccgaggaggugagcuuuagaggcagaggcguguucgagcugagcgacgagaaggccaccaacccaauugugcccagcuucgacaugucgaacgagggcagcuacuucuucggcgacaacgccgaggaguacgacaac

SEQ ID NO: 502 - RNA, 798 nt, Artificial Sequence
  Synthetic Polynucleotide
auggagacccccgcccagcugcuguuccugcugcugcuguggcugcccgacaccaccggcgacaccaucugcaucggcuaccacgccaacaacagcaccgacaccguggacaccgugcuggagaagaacgugaccgugacccacagcgugaaccugggcagcggccugaggauggugaccggccugaggaacaucccccagagggagaccaggggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacauggugaacagcgugaucgagaagaugggcagcggcggcagcggcaccgaccuggccgagcugcuggugcugcugcugaacgagaggacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagggagaagaucgacggagugaaauuggaaucaaugggggucuaucagauccuggccaucuacagcaccguggccagcagccuggugcugcuggugagccugggcgccaucagcuucuggaugugcagcaacggcagccugcagugcagaaucugcauc

SEQ ID NO: 503 - RNA, 744 nt, Artificial Sequence
  Synthetic Polynucleotide
auggagacccccgcccagcugcuguuccugcugcugcuguggcugcccgacaccaccggcgacaccaucugcaucggcuaccacgccaacaacagcaccgacaccguggacaccgugcuggagaagaacgugaccgugacccacagcgugaaccugggcagcggccugaggauggugaccggccugaggaacaucccccagagggagaccaggggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacauggugaacagcgugaucgagaagaugggcagcggcggcagcggcaccgaccuggccgagcugcuggugcugcugcugaacgagaggacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagggagaagaucgaccccggcagcggcuacauccccgaggcccccagggacggccaggccuacgugaggaaggacggcgagugggugcugcugagcaccuuccug

SEQ ID NO: 504 - protein, 13 aa, Salmonella typhimurium
LQRVRELAVQSAN

SEQ ID NO: 505 - DNA, 699 bp, Artificial Sequence
  Synthetic Polynucleotide
atgaaggtgaagctgctggtgctgctgtgcaccttcaccgccacctacgccggcgtggcccctctgcacctgggcaagtgcaacatcgccggctggatcctgggcaaccctgagtgcgagagccttagcacagcctcctcctggagctacatcgtggagacgagcagcagcgataacgggacctgctaccctggcgacttcatcgactacgaggagctgagagagcagctgagcagcgtgagcagcttcgagagattcgagatcttccctaagaccagcagctggcctaaccacgacagcaacaagggcgtgaccgccgcctgcccacacgccggggccaagagcttctacaagaacctgatctggctggtgaagaagggcaacagctaccctaaactgagcaagtcctacatcaacgacaaaggcaaggaggtcctcgtgctctggggcatccaccaccctagcaccagcgccgatcagcagagcctgtaccagaacgccgacgcgtacgtgttcgtgggcaccagcagatacagcaagaagttcaagcctgagatcgccatcagacctaaggtgagggaccaggagggcagaatgaactactactggaccctggtggagcccggagataagatcacatttgaggccaccggcaacctggtggtgcctagatacgccttcgccatggagagaaacgcc

SEQ ID NO: 506 - DNA, 1680 bp, Artificial Sequence
  Synthetic Polynucleotide
atgaaggccatcctcgtggtgctgctgtacacctttgccaccgccaacgccgataccctgtgtatcggctaccacgccaacaacagcaccgacaccgtggatactgtcctggagaagaacgtgaccgtgacccacagcgtgaacctgctggaggacaagcacaacggcaagctgtgcaagctgagaggcgtggcccctctgcacctgggcaagtgcaacatcgccggctggatcctgggcaaccctgagtgcgagagccttagcacagcctcctcctggagctacatcgtggagacgagcagcagcgataacgggacctgctaccctggcgacttcatcgactacgaggagctgagagagcagctgagcagcgtgagcagcttcgagagattcgagatcttccctaagaccagcagctggcctaaccacgacagcaacaagggcgtgaccgccgcctgcccacacgccggggccaagagcttctacaagaacctgatctggctggtgaagaagggcaacagctaccctaaactgagcaagtcctacatcaacgacaaaggcaaggaggtcctcgtgctctggggcatccaccaccctagcaccagcgccgatcagcagagcctgtaccagaacgccgacgcgtacgtgttcgtgggcaccagcagatacagcaagaagttcaagcctgagatcgccatcagacctaaggtgagggaccaggagggcagaatgaactactactggaccctggtggagcccggagataagatcacatttgaggccaccggcaacctggtggtgcctagatacgccttcgccatggagagaaacgccggcagcggcatcatcatcagcgacacccctgtgcacgactgcaacaccacctgccagacccctaagggcgccatcaacacgagcctgcctttccagaacatccaccctatcaccatcggcaagtgccctaagtacgtgaagtcaaccaaactgagactcgccaccggcctcagaaacgtgcctagcatccagagcagaggcctcttcggcgccatcgcgggattcatcgagggcggctggaccggcatggtggacggctggtacggctaccaccatcagaacgagcagggcagcgggtacgcggccgacctcaagagcacccagaacgccatcgacaagatcaccaacaaggtgaacagcgtgatcgagaagatgaacacccagttcaccgccgtgggcaaggagttcaaccacctggagaagagaatcgagaacctgaacaagaaggtggacgacggcttcctggacatctggacctacaacgcagaactgctcgtgcttctggagaacgagagaaccctggactaccacgactccaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccctaagtacagcgaggaggccaagctgaacagagaggagatcgacggcgtgaagctggagagcaccagaatcggctcagccgggagcgccggctacatccctgaggcccctagagacggccaggcctacgtgagaaaggacggcgagtgggtgctgctgagcaccttcctg

SEQ ID NO: 507 - DNA, 693 bp, Artificial Sequence
  Synthetic Polynucleotide
atgaaggtgaagctgctggtgctgctgtgcaccttcaccgccacctacgccggaatcgctcccctgcagctcggcaactgcagcgtggccggctggattctgggcaaccccgagtgcgaactgctgattagcaaagagtcctggagctacatcgtggaaaccccgaatcccgagaacggcacctgctaccccggctacttcgccgactacgaggagctaagagagcagctgagtagcgtgagctcattcgagagattcgagatctttcccaaggagtctagctggcccaatcacaccgtcaccggcgtgtccgccagctgtagccacaacggcaagagcagcttctacagaaacctgctgtggctgaccggcaagaacggactgtaccctaacctgagcaagagctacgcgaacaataaggagaaggaggtgctagtgctgtggggcgtgcaccatccgcccaacatcggcgaccagagagccctgtaccacaccgagaacgcctacgtgagcgtggtgagcagccactatagcagaagattcacccctgagatcgccaagaggccaaaggtgagagatcaggaaggaagaataaactactactggaccctcctggagcccggcgacaccatcatcttcgaggctaacggcaacctgatcgcccctagatacgccttcgccctgagcagaggc

SEQ ID NO: 508 - DNA, 1677 bp, Artificial Sequence
  Synthetic Polynucleotide
atgaaggtgaagctgctggtgctgctgtgtaccttcactgccacttacgccgacaccatttgcatcggctaccacgccaacaacagcaccgataccgtggacaccgtgctggagaagaacgtcaccgtgacccacagcgtgaacctgctggaggatagccataacggcaagctgtgcctgctgaagggaatcgctcccctgcagctcggcaactgcagcgtggccggctggattctgggcaaccccgagtgcgaactgctgattagcaaagagtcctggagctacatcgtggaaaccccgaatcccgagaacggcacctgctaccccggctacttcgccgactacgaggagctaagagagcagctgagtagcgtgagctcattcgagagattcgagatctttcccaaggagtctagctggcccaatcacaccgtcaccggcgtgtccgccagctgtagccacaacggcaagagcagcttctacagaaacctgctgtggctgaccggcaagaacggactgtaccctaacctgagcaagagctacgcgaacaataaggagaaggaggtgctagtgctgtggggcgtgcaccatccgcccaacatcggcgaccagagagccctgtaccacaccgagaacgcctacgtgagcgtggtgagcagccactatagcagaagattcacccctgagatcgccaagaggccaaaggtgagagatcaggaaggaagaataaactactactggaccctcctggagcccggcgacaccatcatcttcgaggctaacggcaacctgatcgcccctagatacgccttcgccctgagcagaggcttcggcagcggcatcatcaccagcaacgctcccatggacgagtgcgacgccaagtgccagaccccgcagggcgccatcaactcgagcctgcccttccagaacgtgcaccccgtgaccatcggcgagtgccccaagtacgtgagaagcgccaagctgagaatggtgaccggcctgagaaacatcccaagcatccagagcagagggctgttcggcgccatcgctggcttcatcgagggcggctggaccggcatggtggacggctggtacggttatcaccaccagaacgagcagggcagcggctacgccgccgaccagaagtccacccagaacgccatcaacggcattacaaacaaggtgaacagcgttatcgagaagatgaacacccaattcaccgccgtgggcaaggagttcaacaagctggagagaagaatggagaacctgaacaagaaggtggacgacggcttcctggacatctggacctacaacgccgaactgctggtcctgctggagaacgagagaaccctggacttccacgactccaacgtgaagaacttatacgagaaggtcaaatcccagctgaagaacaacgccaaagaaatcggaaacggctgcttcgaattctaccacaagtgcaacgacgagtgcatggagagcgtgaagaacggaacctacgactaccccaagtacagcgaggaaagcaaactgaacagagagaagatcgacggcgtgaagttagagagcatgggcgtgggcagcgccggctctgctggatacatccctgaggcccctagagacggccaggcctacgtgagaaaggacggcgagtgggtgctgctgagcaccttcctg

SEQ ID NO: 509 - DNA, 1695 bp, Artificial Sequence
  Synthetic Polynucleotide
atgaaggtgaaactcctcgtcctgctgtgcaccttcaccgccacctacgccgataccatctgtattggctaccacgccaacaactccaccgacaccgtggataccgtgctcgagaagaacgtgaccgtgacccacagcgtgaacctgctggagaacagccacaacggcaagctgtgcctgctgaagggcatcgcgcccctgcagttgggtaactgctccgtggccggctggatcctgggcaaccctgagtgcgagctgctgatcagcaaggagagctggagctacatcgtggagaagcctaaccccgagaacggcacctgctaccctggccacttcgccgactacgaggagctgagagagcaactcagcagcgtgagcagcttcgagagattcgagatcttccctaaggagagcagctggcccaatcacactgtgaccggcgtgtccgcttcttgcagccataacggggaaagctccttctacagaaatctcctttggctgacggggaagaacggcctgtaccctaacctgagcaagagctacgccaacaacaaggagaaggaggtgctggtgctgtggggcgtgcaccaccctcctaacatcggcgaccagaaggccctgtaccacaccgagaacgcctacgtcagcgtggtgtccagccactacagcagaaagttcacccctgagatcgccaagaggcctaaggtgcgggaccaggagggcagaatcaactactactggaccctgctggagcctggcgacaccatcatcttcgaggccaacggcaacctgatcgcccctagatacgccttcgccctgagcagaggcttcggcagcggcatcatcaacagcaacgcccctatggacaagtgcgacgccaagtgccagactccgcagggcgctatcaacagctccctgcctttccagaacgtgcaccctgtgaccatcggcgagtgccctaagtacgtgagaagcgccaagctgagaatggtgaccggcctgagaaacatccctagcatccagagcagaggcctgttcggcgccatcgccgggtttatcgagggcggctggaccggcatggtggacggctggtacggctaccaccaccagaacgagcagggctccggctacgccgccgaccagaaatccacccagaacgccatcaacggcatcaccaacaaggtgaacagcgtcatcgagaagatgaacacccagttcaccgccgtgggcaaggagttcaacaagctggagagaagaatggagaacctgaacaagaaggtggacgacggcttcatcgacatctggacctacaacgccgagcttctggtgctcctggagaacgagagaaccctggacttccacgacagcaacgtgaagaacctgtacgagaaggtgaagtcccagctgaagaacaacgccaaggagatcggcaacggctgcttcgagttctaccacaagtgcaacgacgagtgcatggagagcgtgaagaacggcacctacgattaccccaagtacagcgaggagagcaagctgaacagagagaagatcgacggcgtgaagctggagagcatgggcgtgtaccagatcctggccatctactccaccgtggccagtagcctggtgctgctggtgagcctgggcgcaatcagcttctggatgtgcagcaacggcagcctgcagtgcagaatctgcatc

SEQ ID NO: 510 - DNA, 699 bp, Artificial Sequence
  Synthetic Polynucleotide
atgaaggtcaaacttctcgtgctcctgtgcaccttcaccgccacctacgcgggcgtggctccgcttcacctgggcaagtgcaacatcgccggttggctgctgggtaacccagagtgcgagctactgctgaccgtgagcagctggagctacatcgtggaaaccagcaacagcgacaacggcacctgctaccctggcgacttcatcaactacgaggagctgagagagcagctcagcagcgtgtccagcttcgagagattcgagatcttccctaagactagcagctggcccgaccacgaaacaaacagaggcgtgaccgccgcttgtccatacgccggcgccaacagcttctacagaaacctgatctggctggtgaagaagggcaacagctaccctaagctgagcaagagctacgtgaacaacaagggcaaggaggtgcttgtgctgtggggcatccaccaccctcctaccagcaccgaccagcagagcctgtaccagaacgccgacgcctacgtgttcgtgggcagcagcagatacagcaagaagttcaagcctgagatcgccatcagacctaaggtgagggaccaggagggcagaatgaactactactggactctggtggagcccggcgacaagatcaccttcgaggccaccggcaacctggtggtgcctagatacgccttcgccatggagagaaacgcc

SEQ ID NO: 511 - DNA, 1698 bp, Artificial Sequence
  Synthetic Polynucleotide
atgaaggccatcctggtcgtgctgctctacacattcgccaccgccaacgcagacactctgtgcatcggctaccacgccaacaacagcaccgacaccgtggataccgtgctggagaagaacgtgaccgtgacccacagcgtgaacctgctggaggacaagcacaacggcaagctgtgcaagctgagaggcgtggcccctctgcacctgggcaagtgcaacatcgccggctggatcctgggaaaccccgagtgcgagagcctgtcaaccgcctcgagctggtcctacatcgtggaaaccagcagcagcgataacgggacgtgctacccgggcgacttcatcaactacgaggagctgagagaacagctgagcagcgtcagtagcttcgagagattcgagatcttccctaagaccagcagctggcctaaccacgacagcaacaagggcgtgaccgccgcttgcccgcacgcaggcgccaagagcttctacaagaacctgatctggctggtgaagaagggcaacagctaccctaagctgagcaagagctacatcaacgacaaggggaaggaggtgctagtcctgtggggcatccatcaccctagcaccacagccgaccagcaaagcctgtaccagaacgcggacgcctacgtgttcgtcggcaccagcagatacagcaagaagttcaagcctgagatcgccatcagacctaaggtgcgagatcaggagggcagaatgaactactactggaccctggtggagcccggagacaagattactttcgaagcgaccggcaacctggtggtgcctagatacgccttcgccatggagagaaacgccggcagcggcatcatcatcagcgacacccctgtgcacgactgcaacaccacctgccagacccctaaaggcgccatcaacacaagcctgccttttcagaacatccaccctatcaccatcggcaagtgccctaagtacgtgaagtccaccaagctccgcctggcaaccggcctcaggaacgtgcctagcatccagagcagaggcctgttcggggccatagccggcttcatagagggtggctggaccggcatggttgacgggtggtacggataccatcaccagaacgagcaaggcagcggctacgccgcagacctgaagtcaacccagaacgccatcgacaagatcaccaacaaggtgaacagcgtgatcgagaagatgaacacccagttcaccgccgtgggcaaggagttcaaccacctagagaagaggatcgagaacctgaataagaaggtggacgacggcttcctggacatctggacctacaacgccgagctgctcgtcctcctggagaacgagagaaccctggactaccacgatagcaacgtgaagaacctgtacgagaaggtgagaaaccagctgaagaataacgccaaggagatcggcaacggctgcttcgagttctaccacaagtgcgacaacacctgcatggagagcgtgaagaacggcacctacgactaccctaagtacagcgaggaggccaagctgaacagagagaagatcgacggcgtgaagctggagagcaccagaatctaccagatcctggccatctacagcaccgtggccagcagcctcgtgctcgtggtgagcctgggcgccatctccttctggatgtgcagcaacggcagcctgcagtgcagaatctgcatc

SEQ ID NO: 512 - DNA, 1698 bp, Artificial Sequence
  Synthetic Polynucleotide
atgaagaccatcatcgccctgagctacatcctgtgcctggtgttcgcgcagaaactccccggcaacgacaatagcactgccaccctgtgtctgggccatcacgccgtgcctaacggaaccctcgtgaagacgatcaccaacgaccagatcgaggtgaccaacgccaccgagctggtccagagttcgagcaccggcagaatctgcgacagccctcaccggatcctggacggcgagaactgcaccctgattgacgcactgctaggcgacccacactgtgacggcttccagaacaaggagtgggacctgttcgtggagagaagcaaggcctacagcaactgctacccttacgacgtgcctgactacgccagcctgagatccctcgtggcctccagcggcaccctcgagttcaataacgagagcttcaactggaccggagtcgcccagaacgggacatcctacgcctgcaagagaggaagcgtcaagagcttcttcagcagactgaactggctgcaccagctgaagtacaagtaccctgccctgaacgtgaccatgcctaacaacgacaagttcgacaagctgtacatctggggcgtgcaccatcccagcaccgacagcgaccagacctccctgtacgtccaggcatccggcagggtcaccgtgagcaccaagagaagccagcagaccgtgatccctaacatcggcagcagaccttgggtcagaggcgtctctagcagaatcagcatctactggaccatagtgaagcccggcgacatcctgctgatcaactcgaccggcaacctgatcgctcctaggggctacttcaagatcagaagcggcaagagcagcatcatgagaagcgacgcgcccatcgggaagtgcaactccgagtgcatcacccctaacggcagcatccccaacgacaagcctttccagaacgtgaacagaatcacctacggcgcctgccctagatacgtgaagcagaacacactgaagctggccaccggcatgaggaacgtgcctgagaagcagaccagaggcatcttcggggctattgccggcttcatcgagaacggttgggagggaatggtcgacgggtggtacggcttcagacaccagaacagcgaaggcacgggacaggccgccgacctcaagtccacccaggctgccatcaatcagatcaacgggaagctgaacagactgatcgagaagaccaacgagaagttccaccagatcgagaaggagttcagcgaggtggagggcagaatccaggacctggagaagtacgtggaggacacgaagatcgacctgtggagctacaacgcagagctgttggtggcactggagaaccagcacaccatcgacctgaccgacagcgagatgaacaagctgttcgagaggaccaggaagcagttacgagagaacgccgaggacatgggaaacggctgttttaagatctaccacaagtgcgacaacgcctgcatcgggagcatcaggaacgggacctacgaccacgacgtgtacagagacgaggccctgaacaacagattccagatcaagggcgtggagctgaagtccggctacaaggactggatcctgtggatcagcttcgccatcagctgcttcctgctgtgcgtggtcctcctgggctttataatgtgggcctgccagaagggcaacatcaggtgcaacatctgcatc

SEQ ID NO: 513 - DNA, 1698 bp, Artificial Sequence
  Synthetic Polynucleotide
atgaagaccatcatcgccctgagctacatcctgtgcctggtgttcgcgcagaaactccccggcaacgacaatagcactgccaccctgtgtctgggccatcacgccgtgcctaacggaaccatcgtgaagacgatcaccaacgaccagatcgaggtgaccaacgccaccgagctggtccagaattcgagcaccggcgaaatctgcgacagccctcaccagatcctggacggcgagaactgcaccctgattgacgcactgctaggcgacccacagtgtgacggcttccagaacaagaagtgggacctgttcgtggagagaagcaaggcctacagcaactgctacccttacgacgtgcctgactacgccagcctgagatccctcgtggcctccagcggcaccctcgagttcaataacgagagcttcaactggaccggagtcacccagaacgggacatccagcgcctgcatcagaagaagcaacagcagcttcttcagcagactgaactggctgacccacctgaacttcaagtaccctgccctgaacgtgaccatgcctaacaacgagcagttcgacaagctgtacatctggggcgtgcaccatcccggcaccgacaaggaccagatcttcctgtacgcccagagctccggcaggatcaccgtgagcaccaagagaagccagcaggccgtgatccctaacatcggcagcagacctagaatcagaaacatccctagcagaatcagcatctactggaccatagtgaagcccggcgacatcctgctgatcaactcgaccggcaacctgatcgctcctaggggctacttcaagatcagaagcggcaagagcagcatcatgagaagcgacgcgcccatcgggaagtgcaactccgagtgcatcacccctaacggcagcatccccaacgacaagcctttccagaacgtgaacagaatcacctacggcgcctgccctagatacgtgaagcagagcacactgaagctggccaccggcatgaggaacgtgcctgagaagcagaccagaggcatcttcggggctattgccggcttcatcgagaacggttgggagggaatggtcgacgggtggtacggcttcagacaccagaacagcgaaggcaggggacaggccgccgacctcaagtccacccaggctgccatcgatcagatcaacgggaagctgaacagactgatcggcaagaccaacgagaagttccaccagatcgagaaggagttcagcgaggtggagggcagaatccaggacctggagaagtacgtggaggacacgaagatcgacctgtggagctacaacgcagagctgttggtggcactggagaaccagcacaccatcgacctgaccgacagcgagatgaacaagctgttcgagaagaccaagaagcagttacgagagaacgccgaggacatgggaaacggctgttttaagatctaccacaagtgcgacaacgcctgcatcgggagcatcaggaacgggacctacgaccacgacgtgtacagagacgaggccctgaacaacagattccagatcaagggcgtggagctgaagtccggctacaaggactggatcctgtggatcagcttcgccatcagctgcttcctgctgtgcgtggccctcctgggctttataatgtgggcctgccagaagggcaacatcaggtgcaacatctgcatc

SEQ ID NO: 514 - DNA, 1698 bp, Artificial Sequence
  Synthetic Polynucleotide
atgaagaccatcatcgccctgagctacatcctgtgcctggtgttcgcgcagaaactccccggcaacgacaatagcactgccaccctgtgtctgggccatcacgccgtgcctaacggaaccatcgtgaagacgatcaccaacgaccagatcgaggtgaccaacgccaccgagctggtccagagttcgagcaccggcgaaatctgcgacagccctcaccagatcctggacggcgagaactgcaccctgattgacgcactgctaggcgacccacagtgtgacggcttccagaacaagaagtgggacctgttcgtggagagaagcaaggcctacagcaactgctacccttacgacgtgcctgactacgccagcctgagatccctcgtggcctccagcggcaccctcgagttcaataacgagagcttcaactggaccggagtcacccagaacgggacatccagcgcctgcatcagaagaagcaacagcagcttcttcagcagactgaactggctgacccacctgaacttcaagtaccctgccctgaacgtgaccatgcctaacaacgagcagttcgacaagctgtacatctggggcgtgcaccatcccggcaccgacaaggaccagatcttcctgtacgcccaggcatccggcaggatcaccgtgagcaccaagagaagccagcaggccgtgatccctaacatcggcagcagacctagagtcagaaacatccctagcagaatcagcatctactggaccatagtgaagcccggcgacatcctgctgatcaactcgaccggcaacctgatcgctcctaggggctacttcaagatcagaagcggcaagagcagcatcatgagaagcgacgcgcccatcgggaagtgcaactccgagtgcatcacccctaacggcagcatccccaacgacaagcctttccagaacgtgaacagaatcacctacggcgcctgccctagatacgtgaagcagaacacactgaagctggccaccggcatgaggaacgtgcctgagaagcagaccagaggcatcttcggggctattgccggcttcatcgagaacggttgggagggaatggtcgacgggtggtacggcttcagacaccagaacagcgaaggcaggggacaggccgccgacctcaagtccacccaggctgccatcgatcagatcaacgggaagctgaacagactgatcggcaagaccaacgagaagttccaccagatcgagaaggagttcagcgaggtggagggcagaatccaggacctggagaagtacgtggaggacacgaagatcgacctgtggagctacaacgcagagctgttggtggcactggagaaccagcacaccatcgacctgaccgacagcgagatgaacaagctgttcgagaagaccaagaagcagttacgagagaacgccgaggacatgggaaacggctgttttaagatctaccacaagtgcgacaacgcctgcatcgggagcatcaggaacgggacctacgaccacgacgtgtacagagacgaggccctgaacaacagattccagatcaagggcgtggagctgaagtccggctacaaggactggatcctgtggatcagcttcgccatcagctgcttcctgctgtgcgtggccctcctgggctttataatgtgggcctgccagaagggcaacatcaggtgcaacatctgcatc

SEQ ID NO: 515 - DNA, 1698 bp, Artificial Sequence
  Synthetic Polynucleotide
atgaagaccatcatcgccctgagctacatcctgtgcctggtgttcgcgcagaaactccccggcaacgacaatagcactgccaccctgtgtctgggccatcacgccgtgcctaacggaaccatcgtgaagacgatcaccaacgacagaatcgaggtgaccaacgccaccgagctggtccagaattcgagcatcggcgaaatctgcgacagccctcaccagatcctggacggcgagaactgcaccctgattgacgcactgctaggcgacccacagtgtgacggcttccagaacaagaagtgggacctgttcgtggagagaagcaaggcctacagcaactgctacccttacgacgtgcctgactacgccagcctgagatccctcgtggcctccagcggcaccctcgagttcaataacgagagcttcaactggaccggagtcacccagaacgggacatccagcgcctgcatcagaagaagcaacagcagcttcttcagcagactgaactggctgacccacctgaacttcaagtaccctgccctgaacgtgaccatgcctaacaacgagcagttcgacaagctgtacatctggggcgtgcaccatcccggcaccgacaaggaccagatcttcctgtacgcccagagctccggcaggatcaccgtgagcaccaagagaagccagcaggccgtgatccctaacatcggcagcagacctagaatcagaaacatccctagcagaatcagcatctactggaccatagtgaagcccggcgacatcctgctgatcaactcgaccggcaacctgatcgctcctaggggctacttcaagatcagaagcggcaagagcagcatcatgagaagcgacgcgcccatcgggaagtgcaagtccgagtgcatcacccctaacggcagcatccccaacgacaagcctttccagaacgtgaacagaatcacctacggcgcctgccctagatacgtgaagcagagcacactgaagctggccaccggcatgaggaacgtgcctgagaagcagaccagaggcatcttcggggctattgccggcttcatcgagaacggttgggagggaatggtcgacgggtggtacggcttcagacaccagaacagcgaaggcaggggacaggccgccgacctcaagtccacccaggctgccatcgatcagatcaacgggaagctgaacagactgatcggcaagaccaacgagaagttccaccagatcgagaaggagttcagcgaggtggagggcagaatccaggacctggagaagtacgtggaggacacgaagatcgacctgtggagctacaacgcagagctgttggtggcactggagaaccagcacaccatcgacctgaccgacagcgagatgaacaagctgttcgagaagaccaagaagcagttacgagagaacgccgaggacatgggaaacggctgttttaagatctaccacaagtgcgacaacgcctgcatcgggagcatcaggaacgggacctacgaccacgacgtgtacagagacgaggccctgaacaacagattccagatcaagggcgtggagctgaagtccggctacaaggactggatcctgtggatcagcttcgccatcagctgcttcctgctgtgcgtggccctcctgggctttataatgtgggcctgccagaagggcaacatcaggtgcaacatctgcatc

SEQ ID NO: 516 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcttgagcaccgccagcagctggagcaacatcacggaaacccctagcagcgacaacggcacctgctaccccggcgacttcatcgactacgaggagctgcgggagcagctgagcagcgtgagcagcttcgagcggttcgagatcttccccaagaccagctcttggcccaaccacagcagcaacaagggcgtgaccgccgcctgccctcacgctggcgccaagagcttctacaagaacctgatctggctggtgaagaagaacggcagctaccccaagctgaacaagtcttacattaacgactcaggcaaggaggtgctggtcctgtggggcatccaccaccccagcaacagcaccgaccaacagagcctgtaccagaacgccgacacctacgtgttcgtgggcagcagcaactacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 517 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcaacagcaccgccagcagctggagcaacatcacggaaacccctagcagcgacaacggcacctgctaccccggcgacttcatcgactacgaggagctgcgggagcagctgagcagcgtgagcagcttcgagcggttcgagatcttccccaagaccagctcttggcccaaccacagcagcaacaagggcgtgaccgccgcctgccctcacgctggcgccaagagcttctacaagaacctgatctggctggtgaagaagaacggcagctaccccaagctgaacaagtcttacattaacgactcaggcaaggaggtgctggtcctgtggggcatccaccaccccagcaacagcaccgaccaacagagcctgtaccagaacgccgacacctacgtgttcgtgggcagcagcaactacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 518 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcttgagcaccgccagcagctggagcaacatcacggaaacccctagcagcgacaacggcacctgctaccccggcgacttcatcgactacgaggagctgcgggagcagctgagcagcgtgagcagcttcgagcggttcgagatcttccccaagaccagctcttggcccaaccacgacagcaacaagggcgtgaccgccgcctgccctcacgctggcgccaagagcttctacaagaacctgatctggctggtgaagaagggcaacagctaccccaagctgtccaagtcttacattaacgacaagggcaaggaggtgctggtcctgtggggcatccaccaccccagcaccagcgccgaccaacagagcctgtaccagaacgccgacacctacgtgttcgtgggcagcagccggtacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 519 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcttgagcaccgccagcagctggagctacatcgtggaaacccctagcagcgacaacggcacctgctaccccggcgacttcatcgactacgaggagctgcgggagcagctgagcagcgtgagcagcttcgagcggttcgagatcttccccaagaccagctcttggcccaaccacagcagcaacaagggcgtgaccgccgcctgccctcacgctggcgccaagagcttctacaagaacctgatctggctggtgaagaagaacggcagctaccccaagctgaacaagtcttacattaacgactcaggcaaggaggtgctggtcctgtggggcatccaccaccccagcaacagcaccgaccaacagagcctgtaccagaacgccgacacctacgtgttcgtgggcagcagcaactacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 520 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcaacagcaccgccagcagctggagctacatcgtggaaacccctagcagcgacaacggcacctgctaccccggcgacttcatcgactacgaggagctgcgggagcagctgagcagcgtgagcagcttcgagcggttcgagatcttccccaagaccagctcttggcccaaccacagcagcaacaagggcgtgaccgccgcctgccctcacgctggcgccaagagcttctacaagaacctgatctggctggtgaagaagaacggcagctaccccaagctgaacaagtcttacattaacgactcaggcaaggaggtgctggtcctgtggggcatccaccaccccagcaacagcaccgaccaacagagcctgtaccagaacgccgacacctacgtgttcgtgggcagcagcaactacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 521 - DNA, 699 bp, Artificial Sequence
  Synthetic Polynucleotide
atgaaggtgaagcttctcgtgctcttatgcaccttcaccgccacctacgccggcgtggctccgcttcaccttggcaagtgcaacatcgccggctggatcttgggaaaccccgagtgcgagagcttgagcaccgccagcagctggagctacatcgtggaaacccctagcagcgacaacggcacctgctaccccggcgacttcatcgactacgaggagctgcgggagcagctgagcagcgtgagcagcttcgagcggttcgagatcttccccaagaccagctcttggcccaaccacgacagcaacaagggcgtgaccgccgcctgccctcacgctggcgccaagagcttctacaagaacctgatctggctggtgaagaagggcaacagctaccccaagctgtccaagtcttacattaacgacaagggcaaggaggtgctggtcctgtggggcatccaccaccccagcaccagcgccgaccaacagagcctgtaccagaacgccgacacctacgtgttcgtgggcagcagccggtacagcaagaagttcaagcccgagatcgccatccggcccaaggtgcgggaccaggagggccggatgaactactactggaccctggtggagcctggcgacaagatcaccttcgaggccaccggcaacctggtggtgccccggtacgccttcgccatggagcggaacgcc

SEQ ID NO: 522 - DNA, 1695 bp, Artificial Sequence
  Synthetic Polynucleotide
atgaaggccaatttgttggtccttctatgtgccctagccgccgccgacgccgacacaatctgcatcggatatcacgcaaacaacagcaccgacaccgtggatacggtcttggagaagaacgtgaccgtgacccattccgtgaaccttctcgaggatagccacaatggcaagctgtgtagactcaagggcattgccccgctgcagctgggaaagtgcaatattgctggctggctgttgggcaaccctgagtgtgaccctctgttaccagtgagatcttggagctatatcgtcgaaacccctaacagcgagaacggcatatgctacccaggcgacttcatcgactacgaggaactgcgcgagcagctgagctctgtgtcgagcttcgagcggttcgagatcttccctaaggaatctagctggcctaatcataacacaaatggcgttactgctgcctgtagccacgagggaaagagcagtttctaccggaatctgctgtggctgacagagaaggagggctcctaccctaagctgaagaatagctatgtgaacaagaagggcaaggaggtgctggtgctgtggggaatacaccacccacctaactcgaaggagcagcagaatctgtaccagaatgagaatgcctacgtgtccgtcgtgacctccaactacaaccggcggttcacgcctgagatcgccgagaggcctaaggtgagggaccaggccggacgcatgaactactactggaccctgctgaagcctggcgatacaatcatcttcgaggctaatggaaacctgatcgcgccaatgtacgccttcgccctgtccagaggattcggcagcggcatcatcacatccaacgcctccatgcacgaatgcaacaccaagtgccagacgcctctgggagctatcaatagcagcttgccttaccagaatatccaccctgtgaccattggagagtgtccaaagtacgtgcgcagcgcaaagctgcggatggtcacaggcctgcggaatataccttctatccagagccgaggcctgttcggtgccattgccggcttcatcgagggtggctggaccggaatgatcgacggctggtatggataccaccaccagaatgaacagggcagcggctacgccgccgatcagaagtccacccagaacgcaatcaatggtatcacaaacaaggtgaacactgtaatcgagaagatgaacatccaattcacagccgtgggcaaggagttcaataagctggagaagcggatggagaacctcaacaagaaggtggacgacggcttcctggatatctggacctacaacgcagagctgctggtgttgctggagaacgagagaaccctcgacttccatgatagcaacgttaagaacctatacgagaaggtgaagtcacagctgaagaataacgccaaggagattggcaacggctgcttcgaattctaccacaagtgcgacaacgagtgtatggagagcgtccggaatggcacctacgactatcctaagtatagcgaggagagcaagcttaatagagagaaggtcgatggcgtgaagctggagtcaatgggaatctaccagatcctggctatttattcaaccgtggcatcaagtctggtgcttctggtcagcctgggcgccatcagcttctggatgtgctccaatggcagcctgcaatgccgcatctgcata

SEQ ID NO: 523 - DNA, 1698 bp, Artificial Sequence
  Synthetic Polynucleotide
atgaaggctatcttggtggtgttgttgtacacattcgccaccgccaacgccgacaccctctgcatcggctaccacgcgaacaattcaaccgacaccgttgacaccgtcctcgagaagaacgtgaccgtgactcatagcgtcaacctcctcgaggacaagcataacggcaagctctgtaagcttagaggagtggcccctctccacctgggcaagtgtaacattgcaggctggatcctgggcaaccctgagtgcgagagcctgtcaaccgctagcagctggagctacatcgtggaaaccccatccagcgataacggcacctgctaccctggcgatttcatcgactacgaggagctgcgcgagcagttgagcagcgtctccagcttcgagagattcgagatcttccctaagactagcagctggcctaatcatgactccaataagggcgtgacggccgcctgtcctcacgctggagccaagtcgttctacaagaacctgatctggctggtaaagaagggcaacagctacccaaagctgagcaagtcctacatcaacgacaagggcaaggaagtgctggtgctgtggggaatccatcacccaagcacctctgcggaccagcagtctctgtatcagaacgccgacacctatgtgttcgtaggctcctccagatactccaagaagttcaagccagagattgctatccgcccaaaggtgcgggatcaagagggtcgcatgaattattactggaccctggtcgagccaggcgataagatcacattcgaagccacgggaaatctggtggtgcctagatacgctttcgccatggagagaaacgccggcagcggcatcatcatatccgacacacctgtgcacgactgcaacacaacatgccagacgccaaagggagccatcaacacatctcttccattccagaacattcacccaatcacaatcggcaagtgtccaaagtacgtgaagtccaccaagcttagactggccaccggcctgcgtaacatccctagcatccagtcgagaggcctcttcggcgccatcgccggattcattgaaggtggctggaccggcatggtggacggttggtatggctaccaccaccagaacgagcagggcagcggctacgccgcggacctgaagtccacccagaacgctattgacgagatcaccaacaaggtgaacagcgtgatcgagaagatgaatacccagttcaccgccgtcggcaaggagttcaaccatctggagaagagaatcgagaacctcaacaagaaggtcgacgacggcttcctggacatttggacttacaacgctgagttgttggtgcttcttgagaatgagcggaccctggactatcacgactcaaatgtgaagaacctgtacgagaaggtgagatcccagctgaagaacaatgctaaggaaatcggcaacggctgcttcgagttctatcataagtgtgacaacacctgcatggagtctgttaagaacggcacatacgactacccgaagtactctgaggaggccaagctgaaccgagaggagatagacggcgttaagctagaaagtacaaggatctaccagatccttgccatctactccaccgtggcctccagcctggtgttggtggtgagcctgggcgccatcagcttctggatgtgcagtaacggaagcctacagtgccgaatctgcatc

SEQ ID NO: 524 - RNA, 699 nt, Artificial Sequence
  Synthetic Polynucleotide
augaaggugaagcugcuggugcugcugugcaccuucaccgccaccuacgccggcguggccccucugcaccugggcaagugcaacaucgccggcuggauccugggcaacccugagugcgagagccuuagcacagccuccuccuggagcuacaucguggagacgagcagcagcgauaacgggaccugcuacccuggcgacuucaucgacuacgaggagcugagagagcagcugagcagcgugagcagcuucgagagauucgagaucuucccuaagaccagcagcuggccuaaccacgacagcaacaagggcgugaccgccgccugcccacacgccggggccaagagcuucuacaagaaccugaucuggcuggugaagaagggcaacagcuacccuaaacugagcaaguccuacaucaacgacaaaggcaaggagguccucgugcucuggggcauccaccacccuagcaccagcgccgaucagcagagccuguaccagaacgccgacgcguacguguucgugggcaccagcagauacagcaagaaguucaagccugagaucgccaucagaccuaaggugagggaccaggagggcagaaugaacuacuacuggacccugguggagcccggagauaagaucacauuugaggccaccggcaaccugguggugccuagauacgccuucgccauggagagaaacgcc

SEQ ID NO: 525 - RNA, 1680 nt, Artificial Sequence
  Synthetic Polynucleotide
augaaggccauccucguggugcugcuguacaccuuugccaccgccaacgccgauacccuguguaucggcuaccacgccaacaacagcaccgacaccguggauacuguccuggagaagaacgugaccgugacccacagcgugaaccugcuggaggacaagcacaacggcaagcugugcaagcugagaggcguggccccucugcaccugggcaagugcaacaucgccggcuggauccugggcaacccugagugcgagagccuuagcacagccuccuccuggagcuacaucguggagacgagcagcagcgauaacgggaccugcuacccuggcgacuucaucgacuacgaggagcugagagagcagcugagcagcgugagcagcuucgagagauucgagaucuucccuaagaccagcagcuggccuaaccacgacagcaacaagggcgugaccgccgccugcccacacgccggggccaagagcuucuacaagaaccugaucuggcuggugaagaagggcaacagcuacccuaaacugagcaaguccuacaucaacgacaaaggcaaggagguccucgugcucuggggcauccaccacccuagcaccagcgccgaucagcagagccuguaccagaacgccgacgcguacguguucgugggcaccagcagauacagcaagaaguucaagccugagaucgccaucagaccuaaggugagggaccaggagggcagaaugaacuacuacuggacccugguggagcccggagauaagaucacauuugaggccaccggcaaccugguggugccuagauacgccuucgccauggagagaaacgccggcagcggcaucaucaucagcgacaccccugugcacgacugcaacaccaccugccagaccccuaagggcgccaucaacacgagccugccuuuccagaacauccacccuaucaccaucggcaagugcccuaaguacgugaagucaaccaaacugagacucgccaccggccucagaaacgugccuagcauccagagcagaggccucuucggcgccaucgcgggauucaucgagggcggcuggaccggcaugguggacggcugguacggcuaccaccaucagaacgagcagggcagcggguacgcggccgaccucaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgcagaacugcucgugcuucuggagaacgagagaacccuggacuaccacgacuccaacgugaagaaccuguacgagaaggugagaagccagcugaagaacaacgccaaggagaucggcaacggcugcuucgaguucuaccacaagugcgacaacaccugcauggagagcgugaagaacggcaccuacgacuacccuaaguacagcgaggaggccaagcugaacagagaggagaucgacggcgugaagcuggagagcaccagaaucggcucagccgggagcgccggcuacaucccugaggccccuagagacggccaggccuacgugagaaaggacggcgagugggugcugcugagcaccuuccug

SEQ ID NO: 526 - RNA, 693 nt, Artificial Sequence
  Synthetic Polynucleotide
augaaggugaagcugcuggugcugcugugcaccuucaccgccaccuacgccggaaucgcuccccugcagcucggcaacugcagcguggccggcuggauucugggcaaccccgagugcgaacugcugauuagcaaagaguccuggagcuacaucguggaaaccccgaaucccgagaacggcaccugcuaccccggcuacuucgccgacuacgaggagcuaagagagcagcugaguagcgugagcucauucgagagauucgagaucuuucccaaggagucuagcuggcccaaucacaccgucaccggcguguccgccagcuguagccacaacggcaagagcagcuucuacagaaaccugcuguggcugaccggcaagaacggacuguacccuaaccugagcaagagcuacgcgaacaauaaggagaaggaggugcuagugcuguggggcgugcaccauccgcccaacaucggcgaccagagagcccuguaccacaccgagaacgccuacgugagcguggugagcagccacuauagcagaagauucaccccugagaucgccaagaggccaaaggugagagaucaggaaggaagaauaaacuacuacuggacccuccuggagcccggcgacaccaucaucuucgaggcuaacggcaaccugaucgccccuagauacgccuucgcccugagcagaggc

SEQ ID NO: 527 - RNA, 1677 nt, Artificial Sequence
  Synthetic Polynucleotide
augaaggugaagcugcuggugcugcuguguaccuucacugccacuuacgccgacaccauuugcaucggcuaccacgccaacaacagcaccgauaccguggacaccgugcuggagaagaacgucaccgugacccacagcgugaaccugcuggaggauagccauaacggcaagcugugccugcugaagggaaucgcuccccugcagcucggcaacugcagcguggccggcuggauucugggcaaccccgagugcgaacugcugauuagcaaagaguccuggagcuacaucguggaaaccccgaaucccgagaacggcaccugcuaccccggcuacuucgccgacuacgaggagcuaagagagcagcugaguagcgugagcucauucgagagauucgagaucuuucccaaggagucuagcuggcccaaucacaccgucaccggcguguccgccagcuguagccacaacggcaagagcagcuucuacagaaaccugcuguggcugaccggcaagaacggacuguacccuaaccugagcaagagcuacgcgaacaauaaggagaaggaggugcuagugcuguggggcgugcaccauccgcccaacaucggcgaccagagagcccuguaccacaccgagaacgccuacgugagcguggugagcagccacuauagcagaagauucaccccugagaucgccaagaggccaaaggugagagaucaggaaggaagaauaaacuacuacuggacccuccuggagcccggcgacaccaucaucuucgaggcuaacggcaaccugaucgccccuagauacgccuucgcccugagcagaggcuucggcagcggcaucaucaccagcaacgcucccauggacgagugcgacgccaagugccagaccccgcagggcgccaucaacucgagccugcccuuccagaacgugcaccccgugaccaucggcgagugccccaaguacgugagaagcgccaagcugagaauggugaccggccugagaaacaucccaagcauccagagcagagggcuguucggcgccaucgcuggcuucaucgagggcggcuggaccggcaugguggacggcugguacgguuaucaccaccagaacgagcagggcagcggcuacgccgccgaccagaaguccacccagaacgccaucaacggcauuacaaacaaggugaacagcguuaucgagaagaugaacacccaauucaccgccgugggcaaggaguucaacaagcuggagagaagaauggagaaccugaacaagaagguggacgacggcuuccuggacaucuggaccuacaacgccgaacugcugguccugcuggagaacgagagaacccuggacuuccacgacuccaacgugaagaacuuauacgagaaggucaaaucccagcugaagaacaacgccaaagaaaucggaaacggcugcuucgaauucuaccacaagugcaacgacgagugcauggagagcgugaagaacggaaccuacgacuaccccaaguacagcgaggaaagcaaacugaacagagagaagaucgacggcgugaaguuagagagcaugggcgugggcagcgccggcucugcuggauacaucccugaggccccuagagacggccaggccuacgugagaaaggacggcgagugggugcugcugagcaccuuccug

SEQ ID NO: 528 - RNA, 1695 nt, Artificial Sequence
  Synthetic Polynucleotide
augaaggugaaacuccucguccugcugugcaccuucaccgccaccuacgccgauaccaucuguauuggcuaccacgccaacaacuccaccgacaccguggauaccgugcucgagaagaacgugaccgugacccacagcgugaaccugcuggagaacagccacaacggcaagcugugccugcugaagggcaucgcgccccugcaguuggguaacugcuccguggccggcuggauccugggcaacccugagugcgagcugcugaucagcaaggagagcuggagcuacaucguggagaagccuaaccccgagaacggcaccugcuacccuggccacuucgccgacuacgaggagcugagagagcaacucagcagcgugagcagcuucgagagauucgagaucuucccuaaggagagcagcuggcccaaucacacugugaccggcguguccgcuucuugcagccauaacggggaaagcuccuucuacagaaaucuccuuuggcugacggggaagaacggccuguacccuaaccugagcaagagcuacgccaacaacaaggagaaggaggugcuggugcuguggggcgugcaccacccuccuaacaucggcgaccagaaggcccuguaccacaccgagaacgccuacgucagcgugguguccagccacuacagcagaaaguucaccccugagaucgccaagaggccuaaggugcgggaccaggagggcagaaucaacuacuacuggacccugcuggagccuggcgacaccaucaucuucgaggccaacggcaaccugaucgccccuagauacgccuucgcccugagcagaggcuucggcagcggcaucaucaacagcaacgccccuauggacaagugcgacgccaagugccagacuccgcagggcgcuaucaacagcucccugccuuuccagaacgugcacccugugaccaucggcgagugcccuaaguacgugagaagcgccaagcugagaauggugaccggccugagaaacaucccuagcauccagagcagaggccuguucggcgccaucgccggguuuaucgagggcggcuggaccggcaugguggacggcugguacggcuaccaccaccagaacgagcagggcuccggcuacgccgccgaccagaaauccacccagaacgccaucaacggcaucaccaacaaggugaacagcgucaucgagaagaugaacacccaguucaccgccgugggcaaggaguucaacaagcuggagagaagaauggagaaccugaacaagaagguggacgacggcuucaucgacaucuggaccuacaacgccgagcuucuggugcuccuggagaacgagagaacccuggacuuccacgacagcaacgugaagaaccuguacgagaaggugaagucccagcugaagaacaacgccaaggagaucggcaacggcugcuucgaguucuaccacaagugcaacgacgagugcauggagagcgugaagaacggcaccuacgauuaccccaaguacagcgaggagagcaagcugaacagagagaagaucgacggcgugaagcuggagagcaugggcguguaccagauccuggccaucuacuccaccguggccaguagccuggugcugcuggugagccugggcgcaaucagcuucuggaugugcagcaacggcagccugcagugcagaaucugcauc

SEQ ID NO: 529 - RNA, 699 nt, Artificial Sequence
  Synthetic Polynucleotide
augaaggucaaacuucucgugcuccugugcaccuucaccgccaccuacgcgggcguggcuccgcuucaccugggcaagugcaacaucgccgguuggcugcuggguaacccagagugcgagcuacugcugaccgugagcagcuggagcuacaucguggaaaccagcaacagcgacaacggcaccugcuacccuggcgacuucaucaacuacgaggagcugagagagcagcucagcagcguguccagcuucgagagauucgagaucuucccuaagacuagcagcuggcccgaccacgaaacaaacagaggcgugaccgccgcuuguccauacgccggcgccaacagcuucuacagaaaccugaucuggcuggugaagaagggcaacagcuacccuaagcugagcaagagcuacgugaacaacaagggcaaggaggugcuugugcuguggggcauccaccacccuccuaccagcaccgaccagcagagccuguaccagaacgccgacgccuacguguucgugggcagcagcagauacagcaagaaguucaagccugagaucgccaucagaccuaaggugagggaccaggagggcagaaugaacuacuacuggacucugguggagcccggcgacaagaucaccuucgaggccaccggcaaccugguggugccuagauacgccuucgccauggagagaaacgcc

SEQ ID NO: 530 - RNA, 1698 nt, Artificial Sequence
  Synthetic Polynucleotide
augaaggccauccuggucgugcugcucuacacauucgccaccgccaacgcagacacucugugcaucggcuaccacgccaacaacagcaccgacaccguggauaccgugcuggagaagaacgugaccgugacccacagcgugaaccugcuggaggacaagcacaacggcaagcugugcaagcugagaggcguggccccucugcaccugggcaagugcaacaucgccggcuggauccugggaaaccccgagugcgagagccugucaaccgccucgagcugguccuacaucguggaaaccagcagcagcgauaacgggacgugcuacccgggcgacuucaucaacuacgaggagcugagagaacagcugagcagcgucaguagcuucgagagauucgagaucuucccuaagaccagcagcuggccuaaccacgacagcaacaagggcgugaccgccgcuugcccgcacgcaggcgccaagagcuucuacaagaaccugaucuggcuggugaagaagggcaacagcuacccuaagcugagcaagagcuacaucaacgacaaggggaaggaggugcuaguccuguggggcauccaucacccuagcaccacagccgaccagcaaagccuguaccagaacgcggacgccuacguguucgucggcaccagcagauacagcaagaaguucaagccugagaucgccaucagaccuaaggugcgagaucaggagggcagaaugaacuacuacuggacccugguggagcccggagacaagauuacuuucgaagcgaccggcaaccugguggugccuagauacgccuucgccauggagagaaacgccggcagcggcaucaucaucagcgacaccccugugcacgacugcaacaccaccugccagaccccuaaaggcgccaucaacacaagccugccuuuucagaacauccacccuaucaccaucggcaagugcccuaaguacgugaaguccaccaagcuccgccuggcaaccggccucaggaacgugccuagcauccagagcagaggccuguucggggccauagccggcuucauagaggguggcuggaccggcaugguugacgggugguacggauaccaucaccagaacgagcaaggcagcggcuacgccgcagaccugaagucaacccagaacgccaucgacaagaucaccaacaaggugaacagcgugaucgagaagaugaacacccaguucaccgccgugggcaaggaguucaaccaccuagagaagaggaucgagaaccugaauaagaagguggacgacggcuuccuggacaucuggaccuacaacgccgagcugcucguccuccuggagaacgagagaacccuggacuaccacgauagcaacgugaagaaccuguacgagaaggugagaaaccagcugaagaauaacgccaaggagaucggcaacggcugcuucgaguucuaccacaagugcgacaacaccugcauggagagcgugaagaacggcaccuacgacuacccuaaguacagcgaggaggccaagcugaacagagagaagaucgacggcgugaagcuggagagcaccagaaucuaccagauccuggccaucuacagcaccguggccagcagccucgugcucguggugagccugggcgccaucuccuucuggaugugcagcaacggcagccugcagugcagaaucugcauc

SEQ ID NO: 531 - RNA, 1698 nt, Artificial Sequence
  Synthetic Polynucleotide
augaagaccaucaucgcccugagcuacauccugugccugguguucgcgcagaaacuccccggcaacgacaauagcacugccacccugugucugggccaucacgccgugccuaacggaacccucgugaagacgaucaccaacgaccagaucgaggugaccaacgccaccgagcugguccagaguucgagcaccggcagaaucugcgacagcccucaccggauccuggacggcgagaacugcacccugauugacgcacugcuaggcgacccacacugugacggcuuccagaacaaggagugggaccuguucguggagagaagcaaggccuacagcaacugcuacccuuacgacgugccugacuacgccagccugagaucccucguggccuccagcggcacccucgaguucaauaacgagagcuucaacuggaccggagucgcccagaacgggacauccuacgccugcaagagaggaagcgucaagagcuucuucagcagacugaacuggcugcaccagcugaaguacaaguacccugcccugaacgugaccaugccuaacaacgacaaguucgacaagcuguacaucuggggcgugcaccaucccagcaccgacagcgaccagaccucccuguacguccaggcauccggcagggucaccgugagcaccaagagaagccagcagaccgugaucccuaacaucggcagcagaccuugggucagaggcgucucuagcagaaucagcaucuacuggaccauagugaagcccggcgacauccugcugaucaacucgaccggcaaccugaucgcuccuaggggcuacuucaagaucagaagcggcaagagcagcaucaugagaagcgacgcgcccaucgggaagugcaacuccgagugcaucaccccuaacggcagcauccccaacgacaagccuuuccagaacgugaacagaaucaccuacggcgccugcccuagauacgugaagcagaacacacugaagcuggccaccggcaugaggaacgugccugagaagcagaccagaggcaucuucggggcuauugccggcuucaucgagaacgguugggagggaauggucgacgggugguacggcuucagacaccagaacagcgaaggcacgggacaggccgccgaccucaaguccacccaggcugccaucaaucagaucaacgggaagcugaacagacugaucgagaagaccaacgagaaguuccaccagaucgagaaggaguucagcgagguggagggcagaauccaggaccuggagaaguacguggaggacacgaagaucgaccuguggagcuacaacgcagagcuguugguggcacuggagaaccagcacaccaucgaccugaccgacagcgagaugaacaagcuguucgagaggaccaggaagcaguuacgagagaacgccgaggacaugggaaacggcuguuuuaagaucuaccacaagugcgacaacgccugcaucgggagcaucaggaacgggaccuacgaccacgacguguacagagacgaggcccugaacaacagauuccagaucaagggcguggagcugaaguccggcuacaaggacuggauccuguggaucagcuucgccaucagcugcuuccugcugugcgugguccuccugggcuuuauaaugugggccugccagaagggcaacaucaggugcaacaucugcauc

SEQ ID NO: 532 - RNA, 1698 nt, Artificial Sequence
  Synthetic Polynucleotide
augaagaccaucaucgcccugagcuacauccugugccugguguucgcgcagaaacuccccggcaacgacaauagcacugccacccugugucugggccaucacgccgugccuaacggaaccaucgugaagacgaucaccaacgaccagaucgaggugaccaacgccaccgagcugguccagaauucgagcaccggcgaaaucugcgacagcccucaccagauccuggacggcgagaacugcacccugauugacgcacugcuaggcgacccacagugugacggcuuccagaacaagaagugggaccuguucguggagagaagcaaggccuacagcaacugcuacccuuacgacgugccugacuacgccagccugagaucccucguggccuccagcggcacccucgaguucaauaacgagagcuucaacuggaccggagucacccagaacgggacauccagcgccugcaucagaagaagcaacagcagcuucuucagcagacugaacuggcugacccaccugaacuucaaguacccugcccugaacgugaccaugccuaacaacgagcaguucgacaagcuguacaucuggggcgugcaccaucccggcaccgacaaggaccagaucuuccuguacgcccagagcuccggcaggaucaccgugagcaccaagagaagccagcaggccgugaucccuaacaucggcagcagaccuagaaucagaaacaucccuagcagaaucagcaucuacuggaccauagugaagcccggcgacauccugcugaucaacucgaccggcaaccugaucgcuccuaggggcuacuucaagaucagaagcggcaagagcagcaucaugagaagcgacgcgcccaucgggaagugcaacuccgagugcaucaccccuaacggcagcauccccaacgacaagccuuuccagaacgugaacagaaucaccuacggcgccugcccuagauacgugaagcagagcacacugaagcuggccaccggcaugaggaacgugccugagaagcagaccagaggcaucuucggggcuauugccggcuucaucgagaacgguugggagggaauggucgacgggugguacggcuucagacaccagaacagcgaaggcaggggacaggccgccgaccucaaguccacccaggcugccaucgaucagaucaacgggaagcugaacagacugaucggcaagaccaacgagaaguuccaccagaucgagaaggaguucagcgagguggagggcagaauccaggaccuggagaaguacguggaggacacgaagaucgaccuguggagcuacaacgcagagcuguugguggcacuggagaaccagcacaccaucgaccugaccgacagcgagaugaacaagcuguucgagaagaccaagaagcaguuacgagagaacgccgaggacaugggaaacggcuguuuuaagaucuaccacaagugcgacaacgccugcaucgggagcaucaggaacgggaccuacgaccacgacguguacagagacgaggcccugaacaacagauuccagaucaagggcguggagcugaaguccggcuacaaggacuggauccuguggaucagcuucgccaucagcugcuuccugcugugcguggcccuccugggcuuuauaaugugggccugccagaagggcaacaucaggugcaacaucugcauc

SEQ ID NO: 533 - RNA, 1698 nt, Artificial Sequence
  Synthetic Polynucleotide
augaagaccaucaucgcccugagcuacauccugugccugguguucgcgcagaaacuccccggcaacgacaauagcacugccacccugugucugggccaucacgccgugccuaacggaaccaucgugaagacgaucaccaacgaccagaucgaggugaccaacgccaccgagcugguccagaguucgagcaccggcgaaaucugcgacagcccucaccagauccuggacggcgagaacugcacccugauugacgcacugcuaggcgacccacagugugacggcuuccagaacaagaagugggaccuguucguggagagaagcaaggccuacagcaacugcuacccuuacgacgugccugacuacgccagccugagaucccucguggccuccagcggcacccucgaguucaauaacgagagcuucaacuggaccggagucacccagaacgggacauccagcgccugcaucagaagaagcaacagcagcuucuucagcagacugaacuggcugacccaccugaacuucaaguacccugcccugaacgugaccaugccuaacaacgagcaguucgacaagcuguacaucuggggcgugcaccaucccggcaccgacaaggaccagaucuuccuguacgcccaggcauccggcaggaucaccgugagcaccaagagaagccagcaggccgugaucccuaacaucggcagcagaccuagagucagaaacaucccuagcagaaucagcaucuacuggaccauagugaagcccggcgacauccugcugaucaacucgaccggcaaccugaucgcuccuaggggcuacuucaagaucagaagcggcaagagcagcaucaugagaagcgacgcgcccaucgggaagugcaacuccgagugcaucaccccuaacggcagcauccccaacgacaagccuuuccagaacgugaacagaaucaccuacggcgccugcccuagauacgugaagcagaacacacugaagcuggccaccggcaugaggaacgugccugagaagcagaccagaggcaucuucggggcuauugccggcuucaucgagaacgguugggagggaauggucgacgggugguacggcuucagacaccagaacagcgaaggcaggggacaggccgccgaccucaaguccacccaggcugccaucgaucagaucaacgggaagcugaacagacugaucggcaagaccaacgagaaguuccaccagaucgagaaggaguucagcgagguggagggcagaauccaggaccuggagaaguacguggaggacacgaagaucgaccuguggagcuacaacgcagagcuguugguggcacuggagaaccagcacaccaucgaccugaccgacagcgagaugaacaagcuguucgagaagaccaagaagcaguuacgagagaacgccgaggacaugggaaacggcuguuuuaagaucuaccacaagugcgacaacgccugcaucgggagcaucaggaacgggaccuacgaccacgacguguacagagacgaggcccugaacaacagauuccagaucaagggcguggagcugaaguccggcuacaaggacuggauccuguggaucagcuucgccaucagcugcuuccugcugugcguggcccuccugggcuuuauaaugugggccugccagaagggcaacaucaggugcaacaucugcauc

SEQ ID NO: 534 - RNA, 1698 nt, Artificial Sequence
  Synthetic Polynucleotide
augaagaccaucaucgcccugagcuacauccugugccugguguucgcgcagaaacuccccggcaacgacaauagcacugccacccugugucugggccaucacgccgugccuaacggaaccaucgugaagacgaucaccaacgacagaaucgaggugaccaacgccaccgagcugguccagaauucgagcaucggcgaaaucugcgacagcccucaccagauccuggacggcgagaacugcacccugauugacgcacugcuaggcgacccacagugugacggcuuccagaacaagaagugggaccuguucguggagagaagcaaggccuacagcaacugcuacccuuacgacgugccugacuacgccagccugagaucccucguggccuccagcggcacccucgaguucaauaacgagagcuucaacuggaccggagucacccagaacgggacauccagcgccugcaucagaagaagcaacagcagcuucuucagcagacugaacuggcugacccaccugaacuucaaguacccugcccugaacgugaccaugccuaacaacgagcaguucgacaagcuguacaucuggggcgugcaccaucccggcaccgacaaggaccagaucuuccuguacgcccagagcuccggcaggaucaccgugagcaccaagagaagccagcaggccgugaucccuaacaucggcagcagaccuagaaucagaaacaucccuagcagaaucagcaucuacuggaccauagugaagcccggcgacauccugcugaucaacucgaccggcaaccugaucgcuccuaggggcuacuucaagaucagaagcggcaagagcagcaucaugagaagcgacgcgcccaucgggaagugcaaguccgagugcaucaccccuaacggcagcauccccaacgacaagccuuuccagaacgugaacagaaucaccuacggcgccugcccuagauacgugaagcagagcacacugaagcuggccaccggcaugaggaacgugccugagaagcagaccagaggcaucuucggggcuauugccggcuucaucgagaacgguugggagggaauggucgacgggugguacggcuucagacaccagaacagcgaaggcaggggacaggccgccgaccucaaguccacccaggcugccaucgaucagaucaacgggaagcugaacagacugaucggcaagaccaacgagaaguuccaccagaucgagaaggaguucagcgagguggagggcagaauccaggaccuggagaaguacguggaggacacgaagaucgaccuguggagcuacaacgcagagcuguugguggcacuggagaaccagcacaccaucgaccugaccgacagcgagaugaacaagcuguucgagaagaccaagaagcaguuacgagagaacgccgaggacaugggaaacggcuguuuuaagaucuaccacaagugcgacaacgccugcaucgggagcaucaggaacgggaccuacgaccacgacguguacagagacgaggcccugaacaacagauuccagaucaagggcguggagcugaaguccggcuacaaggacuggauccuguggaucagcuucgccaucagcugcuuccugcugugcguggcccuccugggcuuuauaaugugggccugccagaagggcaacaucaggugcaacaucugcauc

SEQ ID NO: 535 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcuugagcaccgccagcagcuggagcaacaucacggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacagcagcaacaagggcgugaccgccgccugcccucacgcuggcgccaagagcuucuacaagaaccugaucuggcuggugaagaagaacggcagcuaccccaagcugaacaagucuuacauuaacgacucaggcaaggaggugcugguccuguggggcauccaccaccccagcaacagcaccgaccaacagagccuguaccagaacgccgacaccuacguguucgugggcagcagcaacuacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 536 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcaacagcaccgccagcagcuggagcaacaucacggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacagcagcaacaagggcgugaccgccgccugcccucacgcuggcgccaagagcuucuacaagaaccugaucuggcuggugaagaagaacggcagcuaccccaagcugaacaagucuuacauuaacgacucaggcaaggaggugcugguccuguggggcauccaccaccccagcaacagcaccgaccaacagagccuguaccagaacgccgacaccuacguguucgugggcagcagcaacuacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 537 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcuugagcaccgccagcagcuggagcaacaucacggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacgacagcaacaagggcgugaccgccgccugcccucacgcuggcgccaagagcuucuacaagaaccugaucuggcuggugaagaagggcaacagcuaccccaagcuguccaagucuuacauuaacgacaagggcaaggaggugcugguccuguggggcauccaccaccccagcaccagcgccgaccaacagagccuguaccagaacgccgacaccuacguguucgugggcagcagccgguacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 538 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcuugagcaccgccagcagcuggagcuacaucguggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacagcagcaacaagggcgugaccgccgccugcccucacgcuggcgccaagagcuucuacaagaaccugaucuggcuggugaagaagaacggcagcuaccccaagcugaacaagucuuacauuaacgacucaggcaaggaggugcugguccuguggggcauccaccaccccagcaacagcaccgaccaacagagccuguaccagaacgccgacaccuacguguucgugggcagcagcaacuacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 539 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcaacagcaccgccagcagcuggagcuacaucguggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacagcagcaacaagggcgugaccgccgccugcccucacgcuggcgccaagagcuucuacaagaaccugaucuggcuggugaagaagaacggcagcuaccccaagcugaacaagucuuacauuaacgacucaggcaaggaggugcugguccuguggggcauccaccaccccagcaacagcaccgaccaacagagccuguaccagaacgccgacaccuacguguucgugggcagcagcaacuacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 540 - RNA, 699 nt, Artificial Sequence
  Synthetic Polynucleotide
augaaggugaagcuucucgugcucuuaugcaccuucaccgccaccuacgccggcguggcuccgcuucaccuuggcaagugcaacaucgccggcuggaucuugggaaaccccgagugcgagagcuugagcaccgccagcagcuggagcuacaucguggaaaccccuagcagcgacaacggcaccugcuaccccggcgacuucaucgacuacgaggagcugcgggagcagcugagcagcgugagcagcuucgagcgguucgagaucuuccccaagaccagcucuuggcccaaccacgacagcaacaagggcgugaccgccgccugcccucacgcuggcgccaagagcuucuacaagaaccugaucuggcuggugaagaagggcaacagcuaccccaagcuguccaagucuuacauuaacgacaagggcaaggaggugcugguccuguggggcauccaccaccccagcaccagcgccgaccaacagagccuguaccagaacgccgacaccuacguguucgugggcagcagccgguacagcaagaaguucaagcccgagaucgccauccggcccaaggugcgggaccaggagggccggaugaacuacuacuggacccugguggagccuggcgacaagaucaccuucgaggccaccggcaaccugguggugccccgguacgccuucgccauggagcggaacgcc

SEQ ID NO: 541 - RNA, 1695 nt, Artificial Sequence
  Synthetic Polynucleotide
augaaggccaauuuguugguccuucuaugugcccuagccgccgccgacgccgacacaaucugcaucggauaucacgcaaacaacagcaccgacaccguggauacggucuuggagaagaacgugaccgugacccauuccgugaaccuucucgaggauagccacaauggcaagcuguguagacucaagggcauugccccgcugcagcugggaaagugcaauauugcuggcuggcuguugggcaacccugagugugacccucuguuaccagugagaucuuggagcuauaucgucgaaaccccuaacagcgagaacggcauaugcuacccaggcgacuucaucgacuacgaggaacugcgcgagcagcugagcucugugucgagcuucgagcgguucgagaucuucccuaaggaaucuagcuggccuaaucauaacacaaauggcguuacugcugccuguagccacgagggaaagagcaguuucuaccggaaucugcuguggcugacagagaaggagggcuccuacccuaagcugaagaauagcuaugugaacaagaagggcaaggaggugcuggugcuguggggaauacaccacccaccuaacucgaaggagcagcagaaucuguaccagaaugagaaugccuacguguccgucgugaccuccaacuacaaccggcgguucacgccugagaucgccgagaggccuaaggugagggaccaggccggacgcaugaacuacuacuggacccugcugaagccuggcgauacaaucaucuucgaggcuaauggaaaccugaucgcgccaauguacgccuucgcccuguccagaggauucggcagcggcaucaucacauccaacgccuccaugcacgaaugcaacaccaagugccagacgccucugggagcuaucaauagcagcuugccuuaccagaauauccacccugugaccauuggagaguguccaaaguacgugcgcagcgcaaagcugcggauggucacaggccugcggaauauaccuucuauccagagccgaggccuguucggugccauugccggcuucaucgaggguggcuggaccggaaugaucgacggcugguauggauaccaccaccagaaugaacagggcagcggcuacgccgccgaucagaaguccacccagaacgcaaucaaugguaucacaaacaaggugaacacuguaaucgagaagaugaacauccaauucacagccgugggcaaggaguucaauaagcuggagaagcggauggagaaccucaacaagaagguggacgacggcuuccuggauaucuggaccuacaacgcagagcugcugguguugcuggagaacgagagaacccucgacuuccaugauagcaacguuaagaaccuauacgagaaggugaagucacagcugaagaauaacgccaaggagauuggcaacggcugcuucgaauucuaccacaagugcgacaacgaguguauggagagcguccggaauggcaccuacgacuauccuaaguauagcgaggagagcaagcuuaauagagagaaggucgauggcgugaagcuggagucaaugggaaucuaccagauccuggcuauuuauucaaccguggcaucaagucuggugcuucuggucagccugggcgccaucagcuucuggaugugcuccaauggcagccugcaaugccgcaucugcaua

SEQ ID NO: 542 - RNA, 1698 nt, Artificial Sequence
  Synthetic Polynucleotide
augaaggcuaucuuggugguguuguuguacacauucgccaccgccaacgccgacacccucugcaucggcuaccacgcgaacaauucaaccgacaccguugacaccguccucgagaagaacgugaccgugacucauagcgucaaccuccucgaggacaagcauaacggcaagcucuguaagcuuagaggaguggccccucuccaccugggcaaguguaacauugcaggcuggauccugggcaacccugagugcgagagccugucaaccgcuagcagcuggagcuacaucguggaaaccccauccagcgauaacggcaccugcuacccuggcgauuucaucgacuacgaggagcugcgcgagcaguugagcagcgucuccagcuucgagagauucgagaucuucccuaagacuagcagcuggccuaaucaugacuccaauaagggcgugacggccgccuguccucacgcuggagccaagucguucuacaagaaccugaucuggcugguaaagaagggcaacagcuacccaaagcugagcaaguccuacaucaacgacaagggcaaggaagugcuggugcuguggggaauccaucacccaagcaccucugcggaccagcagucucuguaucagaacgccgacaccuauguguucguaggcuccuccagauacuccaagaaguucaagccagagauugcuauccgcccaaaggugcgggaucaagagggucgcaugaauuauuacuggacccuggucgagccaggcgauaagaucacauucgaagccacgggaaaucugguggugccuagauacgcuuucgccauggagagaaacgccggcagcggcaucaucauauccgacacaccugugcacgacugcaacacaacaugccagacgccaaagggagccaucaacacaucucuuccauuccagaacauucacccaaucacaaucggcaaguguccaaaguacgugaaguccaccaagcuuagacuggccaccggccugcguaacaucccuagcauccagucgagaggccucuucggcgccaucgccggauucauugaagguggcuggaccggcaugguggacgguugguauggcuaccaccaccagaacgagcagggcagcggcuacgccgcggaccugaaguccacccagaacgcuauugacgagaucaccaacaaggugaacagcgugaucgagaagaugaauacccaguucaccgccgucggcaaggaguucaaccaucuggagaagagaaucgagaaccucaacaagaaggucgacgacggcuuccuggacauuuggacuuacaacgcugaguuguuggugcuucuugagaaugagcggacccuggacuaucacgacucaaaugugaagaaccuguacgagaaggugagaucccagcugaagaacaaugcuaaggaaaucggcaacggcugcuucgaguucuaucauaagugugacaacaccugcauggagucuguuaagaacggcacauacgacuacccgaaguacucugaggaggccaagcugaaccgagaggagauagacggcguuaagcuagaaaguacaaggaucuaccagauccuugccaucuacuccaccguggccuccagccugguguugguggugagccugggcgccaucagcuucuggaugugcaguaacggaagccuacagugccgaaucugcauc

SEQ ID NO: 543 - protein, 233 aa, Artificial Sequence
  Synthetic Polypeptide
MKVKLLVLLCTFTATYAGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNA

SEQ ID NO: 544 - protein, 560 aa, Artificial Sequence
  Synthetic Polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIGSAGSAGYIPEAPRDGQAYVRKDGEWVLLSTFL

SEQ ID NO: 545 - protein, 231 aa, Artificial Sequence
  Synthetic Polypeptide
MKVKLLVLLCTFTATYAGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRG

SEQ ID NO: 546 - protein, 559 aa, Artificial Sequence
  Synthetic Polypeptide
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVGSAGSAGYIPEAPRDGQAYVRKDGEWVLLSTFL

SEQ ID NO: 547 - protein, 565 aa, Artificial Sequence
  Synthetic Polypeptide
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 548 - protein, 233 aa, Artificial Sequence
  Synthetic Polypeptide
MKVKLLVLLCTFTATYAGVAPLHLGKCNIAGWLLGNPECELLLTVSSWSYIVETSNSDNGTCYPGDFINYEELREQLSSVSSFERFEIFPKTSSWPDHETNRGVTAACPYAGANSFYRNLIWLVKKGNSYPKLSKSYVNNKGKEVLVLWGIHHPPTSTDQQSLYQNADAYVFVGSSRYSKKFKPEIAIRPKVRDQEGRMNYYWTLVEPGDKITFEATGNLVVPRYAFAMERNA

SEQ ID NO: 549 - protein, 566 aa, Artificial Sequence
  Synthetic Polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 550 - protein, 566 aa, Artificial Sequence
  Synthetic Polypeptide
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRGSVKSFFSRLNWLHQLKYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 551 - protein, 566 aa, Artificial Sequence
  Synthetic Polypeptide
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 552 - protein, 566 aa, Artificial Sequence
  Synthetic Polypeptide
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 553 - protein, 566 aa, Artificial Sequence
  Synthetic Polypeptide
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 554 - protein, 233 aa, Artificial Sequence
  Synthetic Polypeptide
MKVKLLVLLCTFTATYAGVAPLHLGKCNIAGWILGNPECESLSTASSWSNITETPSSDNGTCYPGDFIDYEELREQLSSVSSFERFEIFPKTSSWPNHSSNKGVTAACPHAGAKSFYKNLIWLVKKNGSYPKLNKSYINDSGKEVLVLWGIHHPSNSTDQQSLYQNADTYVFVGSSNYSKKFKPEIAIRPKVRDQEGRMNYYWTLVEPGDKITFEATGNLVVPRYAFAMERNA

SEQ ID NO: 555 - protein, 233 aa, Artificial Sequence
  Synthetic Polypeptide
MKVKLLVLLCTFTATYAGVAPLHLGKCNIAGWILGNPECESNSTASSWSNITETPSSDNGTCYPGDFIDYEELREQLSSVSSFERFEIFPKTSSWPNHSSNKGVTAACPHAGAKSFYKNLIWLVKKNGSYPKLNKSYINDSGKEVLVLWGIHHPSNSTDQQSLYQNADTYVFVGSSNYSKKFKPEIAIRPKVRDQEGRMNYYWTLVEPGDKITFEATGNLVVPRYAFAMERNA

SEQ ID NO: 556 - protein, 233 aa, Artificial Sequence
  Synthetic Polypeptide
MKVKLLVLLCTFTATYAGVAPLHLGKCNIAGWILGNPECESLSTASSWSNITETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNA

SEQ ID NO: 557 - protein, 233 aa, Artificial Sequence
  Synthetic Polypeptide
MKVKLLVLLCTFTATYAGVAPLHLGKCNIAGWILGNPECESLSTASSWSYIVETPSSDNGTCYPGDFIDYEELREQLSSVSSFERFEIFPKTSSWPNHSSNKGVTAACPHAGAKSFYKNLIWLVKKNGSYPKLNKSYINDSGKEVLVLWGIHHPSNSTDQQSLYQNADTYVFVGSSNYSKKFKPEIAIRPKVRDQEGRMNYYWTLVEPGDKITFEATGNLVVPRYAFAMERNA

SEQ ID NO: 558 - protein, 233 aa, Artificial Sequence
  Synthetic Polypeptide
MKVKLLVLLCTFTATYAGVAPLHLGKCNIAGWILGNPECESNSTASSWSYIVETPSSDNGTCYPGDFIDYEELREQLSSVSSFERFEIFPKTSSWPNHSSNKGVTAACPHAGAKSFYKNLIWLVKKNGSYPKLNKSYINDSGKEVLVLWGIHHPSNSTDQQSLYQNADTYVFVGSSNYSKKFKPEIAIRPKVRDQEGRMNYYWTLVEPGDKITFEATGNLVVPRYAFAMERNA

SEQ ID NO: 559 - protein, 233 aa, Artificial Sequence
  Synthetic Polypeptide
MKVKLLVLLCTFTATYAGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNA

SEQ ID NO: 560 - protein, 565 aa, Artificial Sequence
  Synthetic Polypeptide
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 561 - protein, 565 aa, Artificial Sequence
  Synthetic Polypeptide
KAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 562 - protein, 562 aa, Artificial Sequence
  Synthetic Polypeptide
METPAQLLFLLLLWLPDTTGDTICIGYHANNSTDTVDTVLEKNVTVTHSVNLLEDSHNGKLCRLKGIAPLQLGKCNIAGWLLGNPECDPLPPMKSWSYIVETPNSENGICYPGDFIDYEELREQLSSVSSFERFEIFPKGSSWPNHNTNGVTAACSHEGKNSFYRNLLWLTKKEGLYPNLENSYVNKKEKEVLVLWGIHHPSNNKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 563 - protein, 562 aa, Artificial Sequence
  Synthetic Polypeptide
METPAQLLFLLLLWLPDTTGDTICIGYHANNSTDTVDTVLEKNVTVTHSVNLLEDSHNGKLCRLKGIAPLQLGKCNIAGWLLGNPECDPLPPMKSWSYIVETPNSENGICYPGDFIDYEELREQLSSVSSFERFEIFPKGSSWPNHTTNGVTAACSHEGKNSFYRNLLWLTKKEGSYPNLKNSYVNKKEKEVLVLWGIHHPSNSKEQQNLYQNENAHVSVVTSNYNRRFTPEIAERPKVRDQAGRMNYYWTLLKPGDTIIFEADGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 564 - protein, 562 aa, Artificial Sequence
  Synthetic Polypeptide
METPAQLLFLLLLWLPDTTGDTICIGYHANNSTDTVDTVLEKNVTVTHSVNLLEDSHNGKLCRLKGIAPLQLGKCNIAGWLLGNPECDPLPPMKSWSYIVETPNSENGICYPGDFIDYEELREQLSSVSSFERFEIFPKGSSWPDHNTNGVTAACSHEGKNSFYRNLLWLTEKKGSYPNLKNPYVNKKEKEVLVLWGIHHPSNSKEQQNLYRNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 565 - protein, 562 aa, Artificial Sequence
  Synthetic Polypeptide
METPAQLLFLLLLWLPDTTGDTICIGYHANNSTDTVDTVLEKNVTVTHSVNLLEDSHNGKLCKLKGIAPLQLGKCNIAGWLLGNPGCDPLLPVGSWSYIVETPNSENGICYPGDFIDYEELREQLSSVSSFERFKIFPKESSWPDHNTNGVTAACSHEGKNSFYRNLLWLTKKESSYPNLENSYVNKKRKEVLVLWGIHHPSNSKEQQNLYQNENAYVSVVTSNYNRRFTPEIAERPKVKGQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIGSAGSAGYIPEAPRDGQAYVRKDGEWVLLSTFL

SEQ ID NO: 566 - RNA, 1686 nt, Artificial Sequence
  Synthetic Polynucleotide
auggagacgccugcucagcugcucuuucugcugcuccugugguugcccgauaccacuggggacacuaucuguaucggauaccacgccaacaacucaaccgauaccguggauacuguccucgaaaagaaugugaccguuacacauucaguaaauuuguuagaggauucucacaaugggaagcugugucgacugaaggggaucgcuccccugcaacuggggaagugcaacaucgcuggaugguugcucggcaacccggaaugcgauccgcugccacccaugaagaguuggagcuauauugucgagaccccuaacucagagaacgguauaugcuacccuggagauuuuaucgauuacgaagagcugcgggaacagcugagcagcgucuccaguuucgaacgguuugaaauauuccccaagggcaguuccuggcccaaucacaacacuaauggcgucaccgccgccugcucacacgaggguaagaacucuuuuuaccgcaaucugcuuuggcuuacuaagaaggaaggacuguacccgaaucuggagaacaguuacgucaacaagaaagagaaagagguccuggugcuguggggaauucaccacccuuccaauaacaaggaacagcagaaucuguaccaaaacgaaaaugcuuacgugaguguggugaccucgaacuauaauagacgauucacaccugagauugccgagcgucccaaaguuagggaccaagccgguaggaugaacuacuacuggacucuccugaagcccggugacaccauuaucuucgaggccaaugguaaucugaucgccccuauguacgcuuucgcacugucacgcggguucggaucugggauaauuacuucgaacgcuagcaugcaugaguguaauaccaagugccagaccccacuuggagcaaucaauuccagccuaccuuaucagaauauucaucccgugaccaucggagaaugcccaaaguacguuagguccgcuaaacugaggauggugacuggcuugaggaacauaccaucuauccaaucuaggggccuguuuggcgcuauugccggguucaucgaggguggcuggacaggcaugauugacgggugguacgguuaccaccaccagaacgagcagggauccggcuaugcagcugaccagaagucaacccagaacgcaaucaacggcaucacaaauaaggucaauacugugaucgaaaagaugaacauccaauucacugccgugggcaaggaguuuaauaagcucgagaagcgcauggaaaaucugaacaaaaaaguggacgauggcuuccuggauauauggacuuacaacgccgagcuccuugugcuucuggagaacgaacguaccuuggacuuucaugauaguaacgucaagaauuuguacgagaagguuaaaucccagcugaagaacaaugccaaggaaaucggcaacggcuguuuugaauuuuaccauaaaugcgacaaugagugcauggaauccguacgcaaugggacauacgauuacccuaaauacuccgaggaaagcaagcucaaccgagaaaaaguggacggcgucaagcucgaaucaauggguauuggcagugccggauccgccggguauauccccgaggccccuagagacggccaagccuaugugcggaaagacggcgaauggguucugcuauccaccuucuua

SEQ ID NO: 567 - RNA, 1686 nt, Artificial Sequence
  Synthetic Polynucleotide
auggagacgccugcucagcugcucuuucugcugcuccugugguugcccgauaccacuggggacacuaucuguaucggauaccacgccaacaacucaaccgauaccguggauacuguccucgaaaagaaugugaccguuacacauucaguaaauuuguuagaggauucucacaaugggaagcugugucgacugaaggggaucgcuccccugcaacuggggaagugcaacaucgcuggaugguugcucggcaacccggaaugcgauccgcugccacccaugaagaguuggagcuauauugucgagaccccuaacucagagaacgguauaugcuacccuggagauuuuaucgauuacgaagagcugcgggaacagcugagcagcgucuccaguuucgaacgguuugaaauauuccccaagggcaguuccuggcccaaucacaccacuaauggcgucaccgccgccugcucacacgaggguaagaacucuuuuuaccgcaaucugcuuuggcuuacuaagaaggaaggaaguuacccgaaucugaaaaacaguuacgucaacaagaaagagaaagagguccuggugcuguggggaauucaccacccuuccaauucgaaggaacagcagaaucuguaccaaaacgaaaaugcucacgugaguguggugaccucgaacuauaauagacgauucacaccugagauugccgagcgucccaaaguuagggaccaagccgguaggaugaacuacuacuggacucuccugaagcccggugacaccauuaucuucgaggccgacgguaaucugaucgccccuauguacgcuuucgcacugucacgcggguucggaucugggauaauuacuucgaacgcuagcaugcaugaguguaauaccaagugccagaccccacuuggagcaaucaauuccagccuaccuuaucagaauauucaucccgugaccaucggagaaugcccaaaguacguuagguccgcuaaacugaggauggugacuggcuugaggaacauaccaucuauccaaucuaggggccuguuuggcgcuauugccggguucaucgaggguggcuggacaggcaugauugacgggugguacgguuaccaccaccagaacgagcagggauccggcuaugcagcugaccagaagucaacccagaacgcaaucaacggcaucacaaauaaggucaauacugugaucgaaaagaugaacauccaauucacugccgugggcaaggaguuuaauaagcucgagaagcgcauggaaaaucugaacaaaaaaguggacgauggcuuccuggauauauggacuuacaacgccgagcuccuugugcuucuggagaacgaacguaccuuggacuuucaugauaguaacgucaagaauuuguacgagaagguuaaaucccagcugaagaacaaugccaaggaaaucggcaacggcuguuuugaauuuuaccauaaaugcgacaaugagugcauggaauccguacgcaaugggacauacgauuacccuaaauacuccgaggaaagcaagcucaaccgagaaaaaguggacggcgucaagcucgaaucaauggguauuggcagugccggauccgccggguauauccccgaggccccuagagacggccaagccuaugugcggaaagacggcgaauggguucugcuauccaccuucuua

SEQ ID NO: 568 - RNA, 1686 nt, Artificial Sequence
  Synthetic Polynucleotide
auggagacgccugcucagcugcucuuucugcugcuccugugguugcccgauaccacuggggacacuaucuguaucggauaccacgccaacaacucaaccgauaccguggauacuguccucgaaaagaaugugaccguuacacauucaguaaauuuguuagaggauucucacaaugggaagcugugucgacugaaggggaucgcuccccugcaacuggggaagugcaacaucgcuggaugguugcucggcaacccggaaugcgauccgcugccacccaugaagaguuggagcuauauugucgagaccccuaacucagagaacgguauaugcuacccuggagauuuuaucgauuacgaagagcugcgggaacagcugagcagcgucuccaguuucgaacgguuugaaauauuccccaagggcaguuccuggcccgaccacaacacuaauggcgucaccgccgccugcucacacgaggguaagaacucuuuuuaccgcaaucugcuuuggcuuacugagaagaagggaaguuacccgaaucugaaaaaccccuacgucaacaagaaagagaaagagguccuggugcuguggggaauucaccacccuuccaauucgaaggaacagcagaaucuguacagaaacgaaaaugcuuacgugaguguggugaccucgaacuauaauagacgauucacaccugagauugccgagcgucccaaaguuagggaccaagccgguaggaugaacuacuacuggacucuccugaagcccggugacaccauuaucuucgaggccaaugguaaucugaucgccccuauguacgcuuucgcacugucacgcggguucggaucugggauaauuacuucgaacgcuagcaugcaugaguguaauaccaagugccagaccccacuuggagcaaucaauuccagccuaccuuaucagaauauucaucccgugaccaucggagaaugcccaaaguacguuagguccgcuaaacugaggauggugacuggcuugaggaacauaccaucuauccaaucuaggggccuguuuggcgcuauugccggguucaucgaggguggcuggacaggcaugauugacgggugguacgguuaccaccaccagaacgagcagggauccggcuaugcagcugaccagaagucaacccagaacgcaaucaacggcaucacaaauaaggucaauacugugaucgaaaagaugaacauccaauucacugccgugggcaaggaguuuaauaagcucgagaagcgcauggaaaaucugaacaaaaaaguggacgauggcuuccuggauauauggacuuacaacgccgagcuccuugugcuucuggagaacgaacguaccuuggacuuucaugauaguaacgucaagaauuuguacgagaagguuaaaucccagcugaagaacaaugccaaggaaaucggcaacggcuguuuugaauuuuaccauaaaugcgacaaugagugcauggaauccguacgcaaugggacauacgauuacccuaaauacuccgaggaaagcaagcucaaccgagaaaaaguggacggcgucaagcucgaaucaauggguauuggcagugccggauccgccggguauauccccgaggccccuagagacggccaagccuaugugcggaaagacggcgaauggguucugcuauccaccuucuua

SEQ ID NO: 569 - RNA, 1686 nt, Artificial Sequence
  Synthetic Polynucleotide
auggagacgccugcucagcugcucuuucugcugcuccugugguugcccgauaccacuggggacacuaucuguaucggauaccacgccaacaacucaaccgauaccguggauacuguccucgaaaagaaugugaccguuacacauucaguaaauuuguuagaggauucucacaaugggaagcuguguaagcugaaggggaucgcuccccugcaacuggggaagugcaacaucgcuggaugguugcucggcaacccgggcugcgauccgcugcugcccguuggcaguuggagcuauauugucgagaccccuaacucagagaacgguauaugcuacccuggagauuuuaucgauuacgaagagcugcgggaacagcugagcagcgucuccaguuucgaacgguuuaagauauuccccaaggagaguuccuggcccgaccacaacacuaauggcgucaccgccgccugcucacacgaggguaagaacucuuuuuaccgcaaucugcuuuggcuuacuaagaaggaaagcaguuacccgaaucuggagaacaguuacgucaacaagaaacggaaagagguccuggugcuguggggaauucaccacccuuccaauucgaaggaacagcagaaucuguaccaaaacgaaaaugcuuacgugaguguggugaccucgaacuauaauagacgauucacaccugagauugccgagcgucccaaaguuaagggccaagccgguaggaugaacuacuacuggacucuccugaagcccggugacaccauuaucuucgaggccaaugguaaucugaucgccccuauguacgcuuucgcacugucacgcggguucggaucugggauaauuacuucgaacgcuagcaugcaugaguguaauaccaagugccagaccccacuuggagcaaucaauuccagccuaccuuaucagaauauucaucccgugaccaucggagaaugcccaaaguacguuagguccgcuaaacugaggauggugacuggcuugaggaacauaccaucuauccaaucuaggggccuguuuggcgcuauugccggguucaucgaggguggcuggacaggcaugauugacgggugguacgguuaccaccaccagaacgagcagggauccggcuaugcagcugaccagaagucaacccagaacgcaaucaacggcaucacaaauaaggucaauacugugaucgaaaagaugaacauccaauucacugccgugggcaaggaguuuaauaagcucgagaagcgcauggaaaaucugaacaaaaaaguggacgauggcuuccuggauauauggacuuacaacgccgagcuccuugugcuucuggagaacgaacguaccuuggacuuucaugauaguaacgucaagaauuuguacgagaagguuaaaucccagcugaagaacaaugccaaggaaaucggcaacggcuguuuugaauuuuaccauaaaugcgacaaugagugcauggaauccguacgcaaugggacauacgauuacccuaaauacuccgaggaaagcaagcucaaccgagaaaaaguggacggcgucaagcucgaaucaauggguauuggcagugccggauccgccggguauauccccgaggccccuagagacggccaagccuaugugcggaaagacggcgaauggguucugcuauccaccuucuua

SEQ ID NO: 570 - DNA, 1686 bp, Artificial Sequence
  Synthetic Polynucleotide
atggagacgcctgctcagctgctctttctgctgctcctgtggttgcccgataccactggggacactatctgtatcggataccacgccaacaactcaaccgataccgtggatactgtcctcgaaaagaatgtgaccgttacacattcagtaaatttgttagaggattctcacaatgggaagctgtgtcgactgaaggggatcgctcccctgcaactggggaagtgcaacatcgctggatggttgctcggcaacccggaatgcgatccgctgccacccatgaagagttggagctatattgtcgagacccctaactcagagaacggtatatgctaccctggagattttatcgattacgaagagctgcgggaacagctgagcagcgtctccagtttcgaacggtttgaaatattccccaagggcagttcctggcccaatcacaacactaatggcgtcaccgccgcctgctcacacgagggtaagaactctttttaccgcaatctgctttggcttactaagaaggaaggactgtacccgaatctggagaacagttacgtcaacaagaaagagaaagaggtcctggtgctgtggggaattcaccacccttccaataacaaggaacagcagaatctgtaccaaaacgaaaatgcttacgtgagtgtggtgacctcgaactataatagacgattcacacctgagattgccgagcgtcccaaagttagggaccaagccggtaggatgaactactactggactctcctgaagcccggtgacaccattatcttcgaggccaatggtaatctgatcgcccctatgtacgctttcgcactgtcacgcgggttcggatctgggataattacttcgaacgctagcatgcatgagtgtaataccaagtgccagaccccacttggagcaatcaattccagcctaccttatcagaatattcatcccgtgaccatcggagaatgcccaaagtacgttaggtccgctaaactgaggatggtgactggcttgaggaacataccatctatccaatctaggggcctgtttggcgctattgccgggttcatcgagggtggctggacaggcatgattgacgggtggtacggttaccaccaccagaacgagcagggatccggctatgcagctgaccagaagtcaacccagaacgcaatcaacggcatcacaaataaggtcaatactgtgatcgaaaagatgaacatccaattcactgccgtgggcaaggagtttaataagctcgagaagcgcatggaaaatctgaacaaaaaagtggacgatggcttcctggatatatggacttacaacgccgagctccttgtgcttctggagaacgaacgtaccttggactttcatgatagtaacgtcaagaatttgtacgagaaggttaaatcccagctgaagaacaatgccaaggaaatcggcaacggctgttttgaattttaccataaatgcgacaatgagtgcatggaatccgtacgcaatgggacatacgattaccctaaatactccgaggaaagcaagctcaaccgagaaaaagtggacggcgtcaagctcgaatcaatgggtattggcagtgccggatccgccgggtatatccccgaggcccctagagacggccaagcctatgtgcggaaagacggcgaatgggttctgctatccaccttctta

SEQ ID NO: 571 - DNA, 1686 bp, Artificial Sequence
  Synthetic Polynucleotide
atggagacgcctgctcagctgctctttctgctgctcctgtggttgcccgataccactggggacactatctgtatcggataccacgccaacaactcaaccgataccgtggatactgtcctcgaaaagaatgtgaccgttacacattcagtaaatttgttagaggattctcacaatgggaagctgtgtcgactgaaggggatcgctcccctgcaactggggaagtgcaacatcgctggatggttgctcggcaacccggaatgcgatccgctgccacccatgaagagttggagctatattgtcgagacccctaactcagagaacggtatatgctaccctggagattttatcgattacgaagagctgcgggaacagctgagcagcgtctccagtttcgaacggtttgaaatattccccaagggcagttcctggcccaatcacaccactaatggcgtcaccgccgcctgctcacacgagggtaagaactctttttaccgcaatctgctttggcttactaagaaggaaggaagttacccgaatctgaaaaacagttacgtcaacaagaaagagaaagaggtcctggtgctgtggggaattcaccacccttccaattcgaaggaacagcagaatctgtaccaaaacgaaaatgctcacgtgagtgtggtgacctcgaactataatagacgattcacacctgagattgccgagcgtcccaaagttagggaccaagccggtaggatgaactactactggactctcctgaagcccggtgacaccattatcttcgaggccgacggtaatctgatcgcccctatgtacgctttcgcactgtcacgcgggttcggatctgggataattacttcgaacgctagcatgcatgagtgtaataccaagtgccagaccccacttggagcaatcaattccagcctaccttatcagaatattcatcccgtgaccatcggagaatgcccaaagtacgttaggtccgctaaactgaggatggtgactggcttgaggaacataccatctatccaatctaggggcctgtttggcgctattgccgggttcatcgagggtggctggacaggcatgattgacgggtggtacggttaccaccaccagaacgagcagggatccggctatgcagctgaccagaagtcaacccagaacgcaatcaacggcatcacaaataaggtcaatactgtgatcgaaaagatgaacatccaattcactgccgtgggcaaggagtttaataagctcgagaagcgcatggaaaatctgaacaaaaaagtggacgatggcttcctggatatatggacttacaacgccgagctccttgtgcttctggagaacgaacgtaccttggactttcatgatagtaacgtcaagaatttgtacgagaaggttaaatcccagctgaagaacaatgccaaggaaatcggcaacggctgttttgaattttaccataaatgcgacaatgagtgcatggaatccgtacgcaatgggacatacgattaccctaaatactccgaggaaagcaagctcaaccgagaaaaagtggacggcgtcaagctcgaatcaatgggtattggcagtgccggatccgccgggtatatccccgaggcccctagagacggccaagcctatgtgcggaaagacggcgaatgggttctgctatccaccttctta

SEQ ID NO: 572 - DNA, 1686 bp, Artificial Sequence
  Synthetic Polynucleotide
atggagacgcctgctcagctgctctttctgctgctcctgtggttgcccgataccactggggacactatctgtatcggataccacgccaacaactcaaccgataccgtggatactgtcctcgaaaagaatgtgaccgttacacattcagtaaatttgttagaggattctcacaatgggaagctgtgtcgactgaaggggatcgctcccctgcaactggggaagtgcaacatcgctggatggttgctcggcaacccggaatgcgatccgctgccacccatgaagagttggagctatattgtcgagacccctaactcagagaacggtatatgctaccctggagattttatcgattacgaagagctgcgggaacagctgagcagcgtctccagtttcgaacggtttgaaatattccccaagggcagttcctggcccgaccacaacactaatggcgtcaccgccgcctgctcacacgagggtaagaactctttttaccgcaatctgctttggcttactgagaagaagggaagttacccgaatctgaaaaacccctacgtcaacaagaaagagaaagaggtcctggtgctgtggggaattcaccacccttccaattcgaaggaacagcagaatctgtacagaaacgaaaatgcttacgtgagtgtggtgacctcgaactataatagacgattcacacctgagattgccgagcgtcccaaagttagggaccaagccggtaggatgaactactactggactctcctgaagcccggtgacaccattatcttcgaggccaatggtaatctgatcgcccctatgtacgctttcgcactgtcacgcgggttcggatctgggataattacttcgaacgctagcatgcatgagtgtaataccaagtgccagaccccacttggagcaatcaattccagcctaccttatcagaatattcatcccgtgaccatcggagaatgcccaaagtacgttaggtccgctaaactgaggatggtgactggcttgaggaacataccatctatccaatctaggggcctgtttggcgctattgccgggttcatcgagggtggctggacaggcatgattgacgggtggtacggttaccaccaccagaacgagcagggatccggctatgcagctgaccagaagtcaacccagaacgcaatcaacggcatcacaaataaggtcaatactgtgatcgaaaagatgaacatccaattcactgccgtgggcaaggagtttaataagctcgagaagcgcatggaaaatctgaacaaaaaagtggacgatggcttcctggatatatggacttacaacgccgagctccttgtgcttctggagaacgaacgtaccttggactttcatgatagtaacgtcaagaatttgtacgagaaggttaaatcccagctgaagaacaatgccaaggaaatcggcaacggctgttttgaattttaccataaatgcgacaatgagtgcatggaatccgtacgcaatgggacatacgattaccctaaatactccgaggaaagcaagctcaaccgagaaaaagtggacggcgtcaagctcgaatcaatgggtattggcagtgccggatccgccgggtatatccccgaggcccctagagacggccaagcctatgtgcggaaagacggcgaatgggttctgctatccaccttctta

SEQ ID NO: 573 - DNA, 1686 bp, Artificial Sequence
  Synthetic Polynucleotide
atggagacgcctgctcagctgctctttctgctgctcctgtggttgcccgataccactggggacactatctgtatcggataccacgccaacaactcaaccgataccgtggatactgtcctcgaaaagaatgtgaccgttacacattcagtaaatttgttagaggattctcacaatgggaagctgtgtaagctgaaggggatcgctcccctgcaactggggaagtgcaacatcgctggatggttgctcggcaacccgggctgcgatccgctgctgcccgttggcagttggagctatattgtcgagacccctaactcagagaacggtatatgctaccctggagattttatcgattacgaagagctgcgggaacagctgagcagcgtctccagtttcgaacggtttaagatattccccaaggagagttcctggcccgaccacaacactaatggcgtcaccgccgcctgctcacacgagggtaagaactctttttaccgcaatctgctttggcttactaagaaggaaagcagttacccgaatctggagaacagttacgtcaacaagaaacggaaagaggtcctggtgctgtggggaattcaccacccttccaattcgaaggaacagcagaatctgtaccaaaacgaaaatgcttacgtgagtgtggtgacctcgaactataatagacgattcacacctgagattgccgagcgtcccaaagttaagggccaagccggtaggatgaactactactggactctcctgaagcccggtgacaccattatcttcgaggccaatggtaatctgatcgcccctatgtacgctttcgcactgtcacgcgggttcggatctgggataattacttcgaacgctagcatgcatgagtgtaataccaagtgccagaccccacttggagcaatcaattccagcctaccttatcagaatattcatcccgtgaccatcggagaatgcccaaagtacgttaggtccgctaaactgaggatggtgactggcttgaggaacataccatctatccaatctaggggcctgtttggcgctattgccgggttcatcgagggtggctggacaggcatgattgacgggtggtacggttaccaccaccagaacgagcagggatccggctatgcagctgaccagaagtcaacccagaacgcaatcaacggcatcacaaataaggtcaatactgtgatcgaaaagatgaacatccaattcactgccgtgggcaaggagtttaataagctcgagaagcgcatggaaaatctgaacaaaaaagtggacgatggcttcctggatatatggacttacaacgccgagctccttgtgcttctggagaacgaacgtaccttggactttcatgatagtaacgtcaagaatttgtacgagaaggttaaatcccagctgaagaacaatgccaaggaaatcggcaacggctgttttgaattttaccataaatgcgacaatgagtgcatggaatccgtacgcaatgggacatacgattaccctaaatactccgaggaaagcaagctcaaccgagaaaaagtggacggcgtcaagctcgaatcaatgggtattggcagtgccggatccgccgggtatatccccgaggcccctagagacggccaagcctatgtgcggaaagacggcgaatgggttctgctatccaccttctta

SEQ ID NO: 574 - RNA, 47 nt, Artificial Sequence
  Synthetic Polynucleotide
gggaaauaagagagaaaagaagaguaagaagaaauauaagagccacc

SEQ ID NO: 575 - RNA, 119 nt, Artificial Sequence
  Synthetic Polynucleotide
ugauaauaggcuggagccucgguggccaugcuucuugccccuugggccuccccccagccccuccuccccuuccugcacccguacccccguggucuuugaauaaagucugagugggcggc

What is claimed is:

1. A vaccine comprising:

(a) a first messenger ribonucleic acid (mRNA) polynucleotide comprising an open reading frame encoding a human influenza hemagglutinin (HA) protein;

(b) a second mRNA polynucleotide comprising an open reading frame encoding a human influenza protein selected from a nucleoprotein (NP), a neuraminidase (NA) protein, a matrix protein 1 (M1), a matrix protein 2 (M2), a nonstructural 1 (NS1) protein, and nonstructural 2 (NS2) protein; and (c) a lipid nanoparticle comprising a compound of Formula (I):

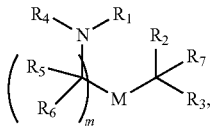

or a salt or isomer thereof, wherein:

$R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a carbocycle, heterocycle, —OR, —$O(CH_2)_nN(R)_2$, —C(O)OR, —OC(O)R, —$CX_3$, —$CX_2H$, —$CXH_2$, —CN, —$N(R)_2$, —$C(O)N(R)_2$, —N(R)C(O)R, —N(R)S(O)$_2$R, —N(R)C(O)N(R)$_2$, —N(R)C(S)N(R)$_2$, —N(R)R$_8$, —$O(CH_2)_nOR$, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13.

2. The vaccine of claim 1, wherein a subset of compounds of Formula (I) includes those in which when $R_4$ is —$(CH_2)_nQ$, —$(CH_2)_n$CHQR, —CHQR, or —$CQ(R)_2$, then (i) Q is not —N(R)$_2$ when n is 1, 2, 3, 4 or 5, or (ii) Q is not 5, 6, or 7-membered heterocycloalkyl when n is 1 or 2.

3. The vaccine of claim 1, wherein a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —$O(CH_2)_nOR$, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

4. The vaccine of claim 1, wherein a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heterocycle having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$, —$O(CH_2)_nOR$, —$N(R)C(=NR_9)N(R)_2$, —$N(R)C(=CHR_9)N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —$N(OR)C(S)N(R)_2$, —$N(OR)C(=NR_9)N(R)_2$, —$N(OR)C(=CHR_9)N(R)_2$, —$C(=NR_9)R$, —C(O)N(R)OR, and —$C(=NR_9)N(R)_2$, and each n is independently selected from 1, 2, 3, 4, and 5; and when Q is a 5- to 14-membered heterocycle and (i) $R_4$ is —$(CH_2)_nQ$ in which n is 1 or 2, or (ii) $R_4$ is —$(CH_2)_n$CHQR in which n is 1, or (iii) $R_4$ is —CHQR, and —$CQ(R)_2$, then Q is either a 5- to 14-membered heteroaryl or 8- to 14-membered heterocycloalkyl;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

5. The vaccine of claim 1, wherein a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —$CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —$N(R)S(O)_2R$, —$N(R)C(O)N(R)_2$, —$N(R)C(S)N(R)_2$, —$CRN(R)_2C(O)OR$, —$N(R)R_8$—$O(CH_2)_nOR$, —$N(R)C(=NR_9)N(R)_2$, —$N(R)C(=CHR_9)N(R)_2$, —$OC(O)N(R)_2$, —N(R)C(O)OR, —N(OR)C(O)R, —$N(OR)S(O)_2R$, —N(OR)C(O)OR, —$N(OR)C(O)N(R)_2$, —$N(OR)C(S)N(R)_2$, —$N(OR)C(=NR_9)N(R)_2$, —$N(OR)C(=CHR_9)N(R)_2$, —$C(=NR_9)R$, —C(O)N(R)OR, and —$C(=NR_9)N(R)_2$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

6. The vaccine of claim 1, wherein subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —$(CH_2)_nQ$ or —$(CH_2)_n$CHQR, where Q is —$N(R)_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{1-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

7. The vaccine of claim 1, wherein a subset of compounds of Formula (I) includes those in which
$R_1$ is selected from the group consisting of $C_{5-30}$ alkyl, $C_{5-20}$ alkenyl, —R*YR", —YR", and —R"M'R';
$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;
$R_4$ is selected from the group consisting of —$(CH_2)_nQ$, —$(CH_2)_n$CHQR, —CHQR, and —CQ$(R)_2$, where Q is —N$(R)_2$, and n is selected from 1, 2, 3, 4, and 5;
each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;
$R_7$ is selected from the group consisting of $C_{1-3}$ alkyl, $C_{2-3}$ alkenyl, and H;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{1-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

8. The vaccine of claim 1, wherein a subset of compounds of Formula (I) includes those of Formula (IA):

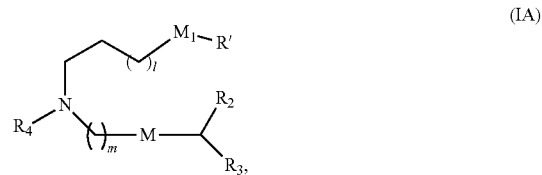

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N$(R)_2$, —NHC(O)N$(R)_2$, —N(R)C(O)R, —N(R)S(O)$_2$R, —N(R)$R_8$, —NHC(=$NR_9$)N$(R)_2$, —NHC(=CH$R_9$)N$(R)_2$, —OC(O)N$(R)_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

9. The vaccine of claim 1, wherein the human influenza HA protein is an H1 subtype or an H3 subtype.

10. The vaccine of claim 1, wherein the human influenza protein comprises neuraminidase (NA).

11. The vaccine of claim 1, wherein the lipid nanoparticle further comprises a PEG-modified lipid, a sterol, and a non-cationic lipid.

12. The vaccine of claim 11, wherein the lipid nanoparticle comprises 20-60 mol % cationic lipid, 0.5-15 mol % PEG-modified lipid, 25-55 mol % sterol, and 5-25 mol % non-cationic lipid.

13. The vaccine of claim 12, wherein the non-cationic lipid is a neutral lipid and the sterol is a cholesterol.

14. The vaccine of claim 1, wherein the first mRNA polynucleotide of (a) and/or the second mRNA polynucleotide of (b) comprise a chemical modification.

15. A method of inducing an immune response in a subject, the method comprising administering to the subject the vaccine of claim 1 in an amount effective to produce an antigen-specific immune response in the subject.

16. A method of inducing cross-reactivity against a variety of influenza strains in a mammal, the method comprising administering to the mammal in need thereof the vaccine of claim 1.

17. The vaccine of claim 1, wherein the cationic lipid of Formula (I) is Compound 25:

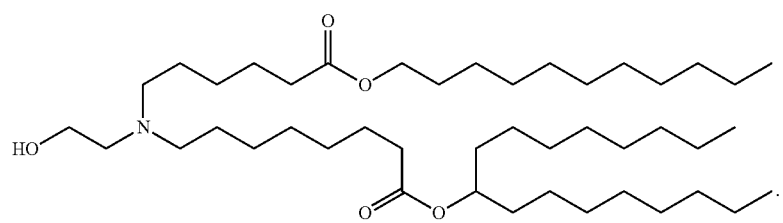

(Compound 25)

18. The vaccine of claim 14, wherein the chemical modification is 1-methylpseudouridine.

19. The vaccine of claim 1, wherein:
$R_1$ is R"M'R' or $C_{5-20}$ alkenyl;
$R_2$ and $R_3$ are each independently selected from $C_{1-14}$ alkyl and $C_{2-14}$ alkenyl;
$R_4$ is —$(CH_2)_n$Q, wherein Q is OH and n is selected from 3, 4, and 5;
M and M' are each independently —OC(O)— or —C(O)O—;
$R_5$, $R_6$, and $R_7$ are each H;
R' is a linear $C_{1-12}$ alkyl, or $C_{1-12}$ alkyl substituted with $C_{6-9}$ alkyl;
R" is $C_{3-14}$ alkyl;
m is selected from 5, 6, 7, 8, 9, 10, 11, 12, and 13.

20. The vaccine of claim 19, wherein:
$R_1$ is R"M'R';
$R_2$ and $R_3$ are each independently $C_{1-14}$ alkyl;
$R_4$ is —$(CH_2)_n$Q, wherein Q is OH and n is 4;
M and M' are each independently —OC(O)—;
$R_5$, $R_6$, and $R_7$ are each H;
R' is $C_{1-12}$ alkyl substituted with $C_{6-9}$ alkyl;
R" is $C_{3-14}$ alkyl; and
m is 6.

21. The vaccine of claim 19, wherein:
$R_1$ is $C_{5-20}$ alkenyl;
$R_2$ and $R_3$ are each independently $C_{1-14}$ alkyl;
$R_4$ is —$(CH_2)_n$Q, wherein Q is OH and n is 3;
M is —C(O)O—;
$R_5$, $R_6$, and $R_7$ are each H; and
m is 6.

22. The vaccine of claim 12, wherein:
$R_1$ is R"M'R' or $C_{5-20}$ alkenyl;
$R_2$ and $R_3$ are each independently selected from $C_{1-14}$ alkyl and $C_{2-14}$ alkenyl;
$R_4$ is —$(CH_2)_n$Q, wherein Q is OH and n is selected from 3, 4, and 5;
M and M' are each independently —OC(O)— or —C(O)O—;
$R_5$, $R_6$, and $R_7$ are each H;
R' is a linear $C_{1-12}$ alkyl, or $C_{1-12}$ alkyl substituted with $C_{6-9}$ alkyl;
R" is $C_{3-14}$ alkyl;
m is selected from 5, 6, 7, 8, 9, 10, 11, 12, and 13.

23. The vaccine of claim 22, wherein:
$R_1$ is R"M'R';
$R_2$ and $R_3$ are each independently $C_{1-14}$ alkyl;
$R_4$ is —$(CH_2)_n$Q, wherein Q is OH and n is 4;
M and M' are each independently —OC(O)—;
$R_5$, $R_6$, and $R_7$ are each H;
R' is $C_{1-12}$ alkyl substituted with $C_{6-9}$ alkyl;
R" is $C_{3-14}$ alkyl; and
m is 6.

24. The vaccine of claim 22, wherein:
$R_1$ is $C_{5-20}$ alkenyl;
$R_2$ and $R_3$ are each independently $C_{1-14}$ alkyl;
$R_4$ is —$(CH_2)_n$Q, wherein Q is OH and n is 3;
M is —C(O)O—;
$R_5$, $R_6$, and $R_7$ are each H; and
m is 6.

* * * * *